United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 34

SEQ ID NO: 427 - DNA, 1694210 bp, Homo sapiens
ctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggtaagtccaggcggagtcattgcctctgcacccaccctgacctggtgggtcaggtccagaaggtctcatggagggaagcgctaggtccccgagaactggcctcctcctagcgccagtctgggcgctctggacgggaactttttcagggtgtgtggaaagatctcgaggcgtgtccccccctacccccaggaggccgagaccctgagcccccttgtgcgtcgcttccagaagcacgtccttccttgccccagagcgcccctccgaagcatccaggctacctcgtccgtcctcctgggagcgagtcctaggtgccaggagcagcgggagcctgcctgcgcactttgattagtctccctggccggctgcaagcgtgcactcagcgcgcccccggaccgctgcctccgcccgcagggtgtgcaggaggaggcatcttagtgacccgggagggtgtttaggtgccccgaaccccttgtgggaggaggggaagagaaggctcacttatgtggagaaagcgccgctgtgtttactggcactggaatcgatgccccgcggtgccacctcgaccccaggggagggggccagccgggaaacctgcgaatgggaaactcctactgtgcccctggttcctgggagccttagagaaccttcaccccagagaaggaaacacaggggtagcagatcttagccctgtgttgttgtgcaggccaggggggggcttgtcagctccaatcaaccaattgtccagctatggaagcgagggcggggctagtggggcgccgctcccatctccccaccgcccaggaggccacttggctgtgagctcctggagcctccctggcgccagctgcggggaccaggtgtcacgcggagcccggaagctgtccactcagcaagggaggggaagaccccgatctaaccttgtcctggagcccccagctccattccttgctgccagggaatggtcagggggctgggagagctcatcgctcctgtgtgggccagagctggggtgcacctgctggcactggaacatctggggtgcggctactgaagagcttggaaatcctggtcaggcagtccgggcaattggcaccccaaaggcggatcttttcagttgaacttgaaaagaagtgggggagtgtggtgaaatagctttgttgagttgaaacatcatgtctcctaacttgggttttcctttattagaataatgattgtttatttttatttttaaactccgttgtgcagagaggcctggccttgacagcccaagtttaggacatgccccagcctgccatcccttccctgccccctgtcctagttcatctcccctccatttatcattttatctttgttacaaaagagagaaaaaaaagatgagagggcctggattctttcaatttttaagtgaccacagaggccccggctggagctactggcagatttatttttagctaagatcttttatgttcagaagcaaaggacctggggcctgtgaagggtaaaggtggtgctggcagtggctgtgctggtaaaaagtggggctgactcaaaacctgtgtcctctttgagctcgtcagggaggccctccgtttggaagaatcccctgggctttccttaagttagcttatggttgcctcgggttaggaagaaaagtcatcattcctcgcggtagtggaagtgacaccttaggggtccagagagtggagctttatggctcagaagagcacagggcttctggatccgttatctgccagctgtgtgaccttgggcaagttgctttacctctctgagcttcgggttgtcacctgtaaaatcagagtttcagtcgtagttctgtcctcagagggtttgggggtaaattacttaaagcactaaacatttagaacagtttggcacatggtaagtgcctgaattctatgagttttgtttctttattctttcaagtagattcctctaatttttgagccttgtagcaccgagtggtacaggaaaggcaggtggcttgccttatacacacacgttttcttttaagtaaggaacagaagcctcaagctctcccattctgctctctgcatgttccaaggaggatcacggacaagctgcccacccactggccaagatataggttggtggcatttgacttgctgtcttgacaagcacctgaaattaagtttttgcagcagttgtacatttcttctgacccactgaaaggacttgatctccttggccccctgggatgaaagtattaccttagcaaatctgtttttttttttttaattagaacatcatttatttaatacatagaatattttgaaaacacaagaatcgaagaatattagaagtggctttatcattcctcctgggattcacacattgcaattagtatgtttagatataaaattttgtggccaggtgcagtggctcatgcctgtaatcccatcactctgggaggctgaggtgggcgtattgcttgagtccaggagttcaagaccagcctggacaacttagcaaaaccctgtctgtactaaaaatacaaacaattagatgggtgtggtggtgcacacatgtaatcccagctaccctggaggctgaagtgggagaatcacctgagcctgagaaggttgaggctgcagtgagccgatatcacgccactgcactccagcctgggtgaccagaatgagaccctgcctcaaaaacaaaacaaaacaaacaaacaaacaaaaaacaatttgtgatagtatctaaacaatttgtgatagtatttaattgtataaacatataaacatctgtggcacacatttgcccataaatgaactgaatgcacaaataccttgatccagtttttagaaagaattttagttttgttgtggcaagaacacaacatgggctgtaccctgtgaaaagatttctaagtatatcatacatgactgttttaaggatagtattgtataggagatgtcaaggagttatttacctttactgcatgagggattcggggatctaaaatcgtcaaactcatagaagcagagagtagaaggttgtggccagggtctcaggggccagggaaatgaggatttgctgatctaatcaacaggtataaagtttcagtaatgttgtaataaatcttgctgtccgtagaacgtacagttttttacatcaccctgaagctacagagttttccactcagaaatgaagctgaaacatgggtctgagcgggtttctcctcctggaattgacccactctgccctatttttcttctcattataattgaagctatatatatatatatatatagaacctgctcctgtaaggtttgagcacaggtcttctagacatcctcatgtctctgatgattttagaaaaaaattaagcttagtccttttagctcgaaccatcccaagctattatattttatcaaagtcctttctgatagtacatattttttgtatccagaaaattgggtctgccctgtataggaatctgacatttcacctttccaaaaattagaccatttcgtttgcatcctttaagctgatgtgtggagtaatgaacacattccaagagggaaatcgtatttgacacagaaaatactttggagacgcagcgatttcccagtggcgtgtaaggagactattgaaatcctagcacgtttgctctgaaggacagagggcagctcgtcctgcctttgccacccagcatgggagttacacagtaagcatcatccacaaattaatactggctgactttcctaaaatcatcctttaatctgtcgctttcacatttacccacagtgtcgtgccggagacctcaaacaccgaggcgacgtttttaaagaagccacgaggctcttcccaatgtctacctccattatttaaaatactgcctcgaggcacaggtataaatattaaaactttaattaaagaatcaatcagtgatggagcttcaaaacaaggggatctagcactttcagatgatgtcaactgtgaacacagttagactcggtcgtagggctaggagtttttatgaaaaatgacgcgtggagttatatacacaggcaactgtcctcattttttgaatctgtagtcattgtgagcactgtcactcattaccactggtttgtcattgttcgctagtcaaagagacatgggtgactgtggcctgctgctacagaagagtgtgttgtcttaggggaaggagtggctaatgcaagaaatatttatttggaatgtaccacatgttagaccctgtgcttggtgaataaggcagacgagaactttcctttcttgtagcttatattgtcgtgggggaagccgcgtcataagcaagacgttgaaatatattttcataaggataatgaaaagggttccaaaaattatagtgtgatagtgacttggggggacattccagagaggagagatttgacctgagaagtacatgaaaagaagtagctgatctgtatggatccatacatttatccaatgagtattctactcatctccgctttcttttttttgaaacagagcctcacgttgtatcccaggctgtagtacagtggtgtgatctcatctcactgccacctccacctcctgggtacaagtgattattatgcttcagcctcctgagtagctgggattacaggtgtgctctgccacgcctggctagtgtttgtatttttagtagggatggagtttccccatgactggtcttaaacgcctgacctcaagtgatccacccgcctcctcggcctctcaaagtgctaggattacaggcgtgagccaccacgcccagcctcattcacccctactttctatgaattcctgagtgttcatcaggcacccactgtgtgccaagcactattgaaagcacttcaagtgcagagtgatcaatacatgcagataccttgtcctaaaagacttccgttctaggatagttgtctgcatggagggcgtttcagagaaggggaccaacaagcacaacgatccagaggctggaatagtgacaaaatcatacagttgaaggttggtcctataggcccttgtggcctgggaagggaccctggctgttattctaatgggaaaccattgggggattttatgcagagagataccaggatatatttatgtcttaaacattatgggaaaattgttaggtgtttttgagatgagtgaataaacaagcatgccttcctggccggccggctctattttttcaaagtttcaattcatttctatgaccagatttggtctgtggacgtagtgacatctgaaaaggtaagccttgcaacgtctgagaaattaaactcgattccccaccaccacctacttcgtagggcttacactaaaatctttcattcaagaagagggattactttatagggaaaaagaacctcattttccagtaatgttctttgtgtgagggtggaagaccctgggaggatacatctgtatacattagcctacttagattttctttctctggggcctcccttcaaagaggcaacatcatgtgttcttgtgtgcctgcatgagcagccgcaccctcccaccaccacatccttttgatggcttgactgacaagtctcctgggagtaccctgagaacagttgcactcagatgccctttattgatcgtctgtccgggtaggttccctttcagagtatggccacagattctcccattggtaggtgtgggccagggtaataacagatattgacagtgcaaagtgggttgcttatggagagctctgagtgcagccgacgttgtccatcttcagaggctaccctgcccttagaaggttgaggtgcaatttgttggagggtttggacacctggacaattcagttttcctcccacattgactgtctctttatccacaatactggaactgcattattgcctattatatgtgacatgaacatcagaataagtgtacatggattgaactcttcctatgtagcacaagctgagccaagcactgtaccttcatggctgtgtgttgtgctatgtgtttcaggcatgtgatcgcctcccccacccacccagcagttcaccttattcgattcctgctcatccttcaggttacaactcaaaagccccaggcttagagaaactgtccctgtttgcctgtgtcgattctcgttttttacagccatcccaggggcatcttatattttattgagtgactctgttttatcctttttctcttactccactccatggtcaactgcaggtggaccatgcatacacctgtttggacatcactgtctccttagcatctagcgtggtgcaaggcacacagcagaagccccatatggaaataatgaattattccatttgatgcttctcacacactttgaggttagtgcttttcagatccccattttgcagatagagagtggggtgtaggcaggcgttaagcaatttgtccaaggacacaacagcaggtaagaggcacttccaagattttgaacctgacagtctgagtccacagcccctgatgctcatcactgtgcacatggcctcttttgctgcctttgcaagatacaagggagggtgggaggcaatgtgtgcagtggttagggagctcttgctgcatagcttgagttgctctgagaagtgatgctgagcccattagagccacaaaaggaaaacaaggcacttgtttctatttattgcagtattactttatcgttgtgtaagagcctcgctagatttctgcactggtgcaatctggctcttgttttgttgtttgtctccttggagtctcaaggccctgggttgcccagggcatctctggcctctttatctaggctcacgctctgagtatgattttgagggagcggttggaccacctgcctggttacaggcagtccttgggcatcatgcagtcacagctggagctgctctgatagccactcaaaatgtggtgtgcaaaccactgctcactccatctaatcaccgtcatctgaatcagcttccctcttcatttcttctgagaacaaaattagatctttgccagcataatggatgaacttgtgcaatcaccttgttcattgctagttctgcatttccccaagatgttgatgtctcttttctgtgaattttagaatatagagtgtcagagatgagggtgaggacttgaggttttcaaaattgtcttctttgtaccatggttgggaccctaatagctatgacactcactggaagctccttctgtgctagggcttcctgtgtgtcatttcattaactcttcatggcaaaccctttattataccacttgacagatgaaggaactgaggcccagtgactaaatggcaaaccgagattgcagactcaagcagttctcttcccctgctgtgtgtggagagggcatgcttgggatgcagggaatagcagaggcaccatgataaggtactaggaaggaggcagtgcaggtatttcactgagattccagaatcagtgtgtctggcttgagatcccagctccatcactttctaagtccataacctttcactttcttcaatttctctgaacctcagtccatccctacaaatggagattatcactacattgtacagtccgtctgaggattaatcagcctggtaaattattttagcaaagtgcctggcacctagtgtgtgtttagtgcaagtaggagtcatagggctgactatgataatcatgacgattactattatccattgataataatgatatcattattaaccttgtttttgttgctagaatttcacaatccctttgggcagcaaattggtcccagaatgtgcttcgtatattttcctcttgactgtaactgaggtgacaaattgagagtgaagggggaagaacccagcgtagctgcaaatgtacggttgagatcgttgacagacttgaggccctgtgtggagttccgcctgcagaggatgctgacagcagccatatgcatgggctctgattgattggcagagagaaacactaatttattagactcgttatgaaaagtgacggagcaggggattgagagggctgattcagcaacagtagccctggctagatcccaggggtattggcttggtgtctgtttcccttgggaccagccccctgtcttgattctgggtcactgcctgtgttctcaagtgagtctcctgaagatgtccatggcatggctcacttttaccacgttgtaaatgtcatacctatttcttcagtatccttagaaagctgagtccagttcaggttgctgttgattgcaaaggctgataagaggagggagggagtgtgtgcatgcagaaattccccagtggagggaaaatagtccttttcacaggttagagaaagtgcagtagtttccttgagggagaataaagggcatggttgatacctctctttaagaacatgatgaccgggcatggtggctcctgcctgcaatcccaacactttgggaggctgaggcaggaagattgcttgagccaggagttggagaccagcctaggcaacataatgagaccctgtctctgttaaaaaaaaaaaaaaaaaaaaaaaaattagctgggtgtggtagctcatgcctgtagtcctagctactcaggaggctgggacaggattgcttggctctgggagtttaaggctgctatgagctgtaattgtgccactgcactccatccttggcaacagagcaagaccctatctgtaaaaaaaaagaacatgaagctctttgtagaaagatttctcatttctgatttggagagattgttcagtctgaattacagcaggtaggatgctggttaaagaagtgtcttgccttcaaggtgataaggcactgaatggggctatgttggagtcagaaaagctttgagaagactgaattccctgagcgccaaggtgcgaaaggacaaagtcatggcagccaggtacacttaacttgtggatccagattctgccacttcctggctgtgtgagcttgggccagttactgcacctctctgagcctccatttacttgtctattaaaaggcaaatgattctgtctccaaggatggctacctgggagtgagttaagtcaagcagcaatcacacagacttccgagctagtcacttcttatttttttttaccttgtggtattcagacaatagcctctcaccccatgactctttgatacaaaaggttccctagttagtgtgctgtgatttgtggaaagatattttgtttcctagtgaatttcattcattttgctcaggaaactttattggttttgtctgtgtaaacctaaaataatcttcaaaagttcataacaagaacaaggaaccatccaccccattctataaacttatttctactgaattgtgcttcgctggtgtcagtttataatgagaaatagtataagaaagccgattagccacaaattttaaaaacttgacattatatatgcacactgaaagaggatagactatttaaagtttgagaatttttacagttgaatctagcatttgaaagaaaaacatggccgggcgtggtggctcacgcctgtaatcccagcactttgggaggctgaggcgggtggatcacgaggtcaggagatcgagaccatcctggctaacatggtgaaaccccgtctctactaaaaatacaaaaaattagccgggcgtggtggcgggtgcctgtagtcccagctactcggaaggctgaggcaggagaacggcgtgaacatggggagcggagtttgcagtgagccgagatcgcgccactgtactccagcctgggcgacagatcgagactccgtctcaaaaaaaaaaaaaaaaaaaggggaaagaaaaacatgttattgaatgtaggtgagggataagaaccaagaacttctggtaagaacccagcaggacaagcgagctatgaagaattcaactctctaatgttatttgctatgattattattgttatttttttgagacagagagtctcatttgttgcccaggctggagtgcagtgatgcaatcatgtctcacttcaacctctgcctcctggactcaagtgatcccacctcagcctcttgagtagccaggaccacaggcatgtgccaccaagcctggctaattttcgtgtttttaaatttttgtatttttttgtagagttgtgatttcaccatgttgcccaggctggtcttgaactcctggggtcaagcaatcttcccttacaaagtgctgggattacaggcatgagccactatgcccagccctatgatgatatttttgaggactctgttggctattactgtgttagctttggtttcaggatcagaaagagtttgtcctttcttcaggttctgattggtatttatgtaccagacacttctaagtggaatacctgtccatgttcccttttcacaaagcctgccaggaatctcagagctgattttatagttcagtcacagtagtaaatagaatttgatagcatggattttgcgtattaacctcacttttgactcagttttatttctctacccttccattttaattttctctttttattgtgatgtatgttactgtatcaaaagaatacctttgcaaggtacctaatgtgaacatattcaaatattgaataagaaagcaatataaaggtatataaggtaggtgaacattgaaaggtatacataaattacagccctttaaaacaccaggaaccctggaaaataggaccatatagtgcagtgcttggtatcttgagctagacctgaagttagagaaatgcaattttgagtcccaacagtgcaaatggttactctttcttattttctccttttaaaaaacattttcctggagcactatttatgctatataaattcacttttattgggccatttattgcctttttcatgcattcagcaaacatttttgagcccatgctctgggccaggcactgttaggcactggggatactgtatggggtgggtatattgaccaatattgacatcatctctgcctagtgaaacttatgctgtagtgagagagactgacacgaaacatgaatgcaggtaaaaagacaatagaattacccgttatcataagtattaaaacggcaacagaatggagcattcatgtaataaaagagtgagtgaccctgttcggtaggaacatcagggaaatgtctccaaggagaggtattgggccacatttaagctacggcctgaagactgagaagggccaagctgtgaccagtggggagaagagaagagaggagaccatggtgagcagaggtggcagtgtgttcagaagcccgggggaggaaggagagggctctgcacatcctgagaacagcaaggtggccagcgtgcctggggtggtgagagcaagggaagggatgtggctggcaaagcctgcagaggccagaacaggcagccttgctctcaggagcctgtgccctgtgttatttttgagatggggaagatcttaactagtaccatcctttataagcatattcaagataggtgcgagaataaggtacaaggagcaccatgccagaaaagcaatgtgtgtgcctctgtgtgtgcatgtgtagatgtgtacacttgtatgtgcacatgagtggatgtgcacacacatctctgtatgtgtgcaaacgtgcatttttgtgtacatttctgcacgtgtgtgtatgtatgtacatgcatgtatgtggcatgcgcatacgtgcatgtattgcagcaggaagagaaggagccacgaacagtatgacagtggggagattgctgacttcagagcccagcagaatgagggtcagtgttgctgggcacgctgcttacagcatgtgcagagcatagctctgttttgcctcacatccctcctggactgatccctttctgtttgtatggtacattcagtgagtgacagcatcacaggaggcagaccccagccttatgaacatatcttcataacaccatacagtctcacgagaaaggggaggtcatttgttcactgtagtccacccctgaattgttccctcactggctctgtgtcactttcagagatttttttaaattctgggaaatgctttggggacttcggcattttggagtgtgttttcaaggattgtattagcaccacagagacccttagcctctttcttaaaggttctgtttttagacatcctcctcttttatccgtgctttcaattctgctgcttccttccttctgagattccttcttccttgctggtcttggaacaagaaacatttagctgtattttcctcgttctcgcctaggtagggtgtggtccccctgtgtcctcatttgttcaacattttgagacaaagattggtggaattgccacttaaaaaaataaaaccagggaaagcagctcagagaatttaatttgcctctaacccaactcttctacttattaaaaaaatatacaattattcattccgtagcactccagattgcttcactgaaagaaagaaagaaagggatccactccagggagaaagaggctcttgagctttttgttccttgatgatcctgtctttacgtaatttggtggagcctactggggaatcatcattttgggagactatggatgtgcctcattgcagaagaataagtagagagcagtgtctggaacaaatgcttgtcttaaaaaaagtttatgaaatgccagcagatgtcagtgtgcccttgccatttgattttttttttaaagcaacattaattattttcggtagtaaaaacaacacaagtatattctgctacagttataaatgaaaagatcatgaggcaacgttttttaggtttggagaaggaccagcagaatttatgtcataaggtaaaatcctctaaattatctgtgtaatataatttgtcttttcccagaaaagtggtttcaaaatgcaaaacctagtgtaagttttttttttttttttccctctctcccagccattgttcaggtgccaataatagcttaggatccagcttagcttctgagaagctactggctctgctaattgataacagctccttatttcaaagctggagtttgcaaaggaaggtagtgtagggttgggtatggccttgtcgtttgtcatctgagttgtgatgagaaactcttgcagtttacgttgttaccgtgagcacagcaaattgcgtgctaatagttagttcctccgcagacattgtttggatcaaaaatgagggcctctatacaggaaaaagattcactcaaataattaaaaactattcattttaagcaagggataatttgccagcatgtagtgcaagagaggtagggtcgtttctaggcagggaatgatgtatgttacagggcatatttgatgctttgctttatttatttaatagttttgattaaatggtacaatattcaaaaatgcaggagtatgcagagaaaaataaatctctcttgcacttgccttgcagtttattagagacaactatttttatagtttctcatgcaccctttcatatatattttatgcgaatacaaacatttacacagatatttataccaacaaaagatagcatatgaaatgcatagttccactgtttgctctttttaaaaaaattaagaataccttttaaggattattccctctcattgtgtgtgtgtgtgtgcacacgcacgtgtattttttctgctccacctttgttaatggatatatagtattccattgcacatgcttacattatttaattggcctccttttgatggatatttatgttgtttccatttttgaagcgctacatggaatatcttcaaccgccaccacttcccacacatgtctgtaggatacattcttagaggtgaaattgttaggtcaaaggaaacatgcctttcattttgacagacactgccaaacctgatgctctggctgagctgcacccttacatgttggtggatgaatggggtttagaaccaaatgaagccatgtggtgattctggtctgacttggctaccgtgatgactgtcatgaattatgtccctattggaagtgtcttagtctagttctgctgctataacaaaatgcttatccagggtgatttagaaagaataggaatcgttggccaggcgcggtggctcatgcccgtaatcccagccctttgggaggccgaggtgggcggatcacctgaggtcgggagttcaagacctgcctggccaacttagtgaaaccatgtctctactaaaaatacaaaaattagctgggggtggtggtgggtgcctgtaatcccagctacttgggaggctgaggcagaagaattgcttgaatggagtcggaggttgcagtgagctgagattgcgccactgcactccagcctgggtgacagagcgagactgttgcgcaaaaaaaaaaaaaaaaaaaaaaaaaagaaaagaaaagaaaagaaaggaatagaagagaagttgttttctcatagttttggaggctgggaagtccatgatcaaggtgtggcaagttcaatgtctagtgagggatgcccgctctgcatccaagatggtgcttcctggctgcatcttcatatggtggaaggtagaagtgctgaagagtctgactagttctctccaacctttgggtaaggttcccatctaagcatgaaggcagagtcttcatggtctaaacagtccttaatagtgttgcattggagaataagtttgaacgtgaattttggcggggacacaaaccttcataccgtaacagaatgttttgcagttcttgtcattgctgtttttttgctaacactttccatctgccaagtagtttgttaagatctttaattccacgttcacatctttgtcctcataacaaccctgtggagtagaccctgctctcatcctgtttcaggatggggatgtgggggctgagagacctcaggtgctttgcttagggttacagggtggatggtcagctcaggagtcacactcagggcctctaggcttaaccattgagctgggaagctgtggtgggttttaagcagcagagagcatactattgagttacaatgagtttaatgtcaacccgattgtgctgttgaccttttggattgcataattatctgttgtgcaggctgtcctgtacactgtaggatgtttaatagcatccctggcctctacctgctagatgttagtagcacccccttcacccatccatgacaaccaaagacgtctccagattttgccaaacgtccctggggtagaaccttgccccactaactcagacaaagagcaaaatatgccgtgggcatctgtagcataacaccagagacatgtatttgaggacacacatggtggctgatgtcagggcatcttccattcagccgtctcagccaagggacactcatttagttcttccccaaggatggagcagatgggctgccccttgtggcagatgccagtctaggaagaaacaagacggtattactcaaaccatttcatcctccattcgatcacagtagcactgcccaacaagactttgtcttttaaaatgtagtttagaaacgtccttgaaaaattgcctggtaaagtagacttataaaaaattatgttcccaactatagtccagcttatatattatacagcttttctattcctgcattttcctttggtgttcagtaatgctctacatcaaaatggcaagcgggaggcatcagccctcccagctccctgcacgtggcagacattgataatcaattcttttcccccctcatcagcgtcaccttcttagaatcctcagtgcatctctctaggcatagactgtcaaccaattggaattactatgtgaaatgaaatgtatttgccacccctgttacatggtgcctttttggctgagaagaaggattacgctttccaaagaggcaagcttatcatgaggtattagcttatttttcagttactctgagaaaagtgcttgatagatgggaagaaatgtctattcttaaagcatttggaattacgatcttattttgtaacagtaattgggtgcctgaagaatactcctctttcctgaggtgctttacatatactatcatcctatgtattattgtttttctgtagtaacatctctctcccctccaccaccaaaaatcagtcccctcccttcaaagcctggtggaggcagccacctgagggtgacacaaaacgctttgtgtacaatgggaactgagacaattccctcagcaaagaacattgagaagctgcaggacgttactggaactgtgtcacttctcagcacagggcatgtgagggagctttaaagagatggggaactgaaccatccaagatttccagaagtaacttctgatgtataaaggcatggaggccaggctgctctgggaaggcaacacaggtttcagagttgaaaatgcttttaggtggcatcatagaaccatccattctagcataatgttttgtgttttttttttgccattgcttttttggggaggggtggaaaaactcccatggaattgtgtggtaacttggtaatttggtttagtaacttgatgaacctatatgcaaatacctatcacttagatagtttttaagtcatctcctgtttctgattctaagaaaatagagaaaaataatcttggaaagaaaaggccctgggtcagacagtgtctgtctctttttatttttcagactggtgggaatgttttcctttctccacttttagatgttttagtctgtgagagatagggacaaatacaacacgtctcctatttcctcttctgagaaaggaatttttaacttagatgggaggcaccagtgaacttcaagggcttgaaattgcatttaaaatttaaagaataaacatttttatctgggcagaaggctcatagctttttaaaaatcacattctcaaagtgctatatgggacacacaaaaaagtaagagcccatctttttcagaacaataactttcagactcttttaccatgaccctagtaggcaaggaaaaaggatactacagcccaaccacttcacctgttttaaccttctggtgggactgtgtgtgttggaggtggggggagacagggaggtcacagaaagctcagtagtgatgaaggattggggtgcaactgtatttggtgggagagatacttacctcttacttagcagtaggaatatgcatttatttgagtcacaatctctgtatgtcttaaagtccaattatttagaaattatcagaaaaaagtgcagttaatgctaaagtgttagcattaaccaaaccccataaaaccacaacagtaatgttttcttaaaacattgaattgagtcccgcttaacaactttgataatagcatgagatcagaaagtccttcctgaaaattccaagaatgaaagccgtgtgcatgagtttttgcgggagaatatttgcaacatttctgtgaagttcttgatagctagacttcctggtacaacatttaattgtagtccttagtaaacttttgtaataatttatgttgatttttcaataatactttcaagttttcaattttactaactcagtggaatactactgttggtatctattggtcacttacaaaaaaaaaaaaaacagtccgttgaatgcattttctttcttttttttcttttttttgttttgttttgttttattttttgtttttggagacggaatctcgctctgtcgcccaagctggagtgcagtggtgcaatctcggctcactgcaacctccgcctcctggattcaatcgattctcctgcctcagcctcctgtgtagctgggactacaggtgcccgccaccacgccaggctaattttttatattttagtagagacagggtttcaccgtgttgcccaggctggtctcaaactcctgaactcagacaatctgcccacctcggcctcccaaagtgctaggattacaggtgtgagccaccacacctggcctgtagaatgcatttcaatgtgcataacgctaatgaaaagacttgcagttttggttcagttaatggcccattgtgaggactctttaggtctgtatacttaggcatgatacattattgctgtaggaagttagagaagatgggaagcacagggcttccattctacagatatccctatattttttggcgggggattgactccgcaaaccatattttctaaactttttcatatatacttgcttatgaatatattggaagcaagcctatatttatttattattttattttattagttttttttttttgagatggcatctaactcaccctgtcatccaggctggagtgcagtggtgcaatcttggcccactgcagcctccgcctcctggactcaaatgattctcctgcctgagcctcctgagtaggtgggattacaggcgtgcaccatcacacccagctaatttttgtatttttggtagagacagggttttaccatgttggtcaagctggtctcgaactcctgacctcaagggatctgcccacctcagcctgccaaagtgctggaattacaggtgtgagccactgcaccctgccccaagctatatgtacactgtacctcaatatccatatatatatccgtggagatatatatatatatatatatcatccatatatatatatcatccatatatatatataaaatccatatatatatatatatctccatggagatatatatatatatgtgtatgaatgaagcacttagtaggagcttttgtgacccattattaagcaaaatgaataaagttcattaaaatgaaactgtatttgattgctttagagctttgattttttttttttttcttgaacaaattctgcagaaaagctaagtggaattatttaccacttgggttggatttttggttatccttcctatttaaggccacacccagcaatcctaatagagttgaatggctgtgtttttaaatacgcagtgattctattggactcatgccaagcagcatcctggattttctgtgcatcagtgtctatgtgtggattagcactgacatattacataccagccaatgtcctctgctctcttcatgtatgctggtttgcaaaaaaaaaaaaaaaaaaaaaaaaagtagaaaaattaaaaatgctgaatcccgcagaaagtttccactccccagaccaaactgtgtgcatagcggggagaagggaccagatggccagtgggttgaaatcagtggaaaaccagctgggatgcatgagagggcatttcctcttccacttccctggaagcctggtcggggcaagtcctggaggtctgagcaggacaagaggtgtcaatgtcatggcctctgtctggctttctggatccttagatgaattgcagttggattggaatttggcacaaaaatctgaggataagctgttagttttctgctttctggaaaaaaaaaaaaaaaaaacagaacaaaacatgccagcttgacagaaggttggagggtaaaatgctgatgaacaggaaagaaccatatttccctgcgttagcaccagcttggagaccgaagttctatgaggagggcacatgatttgggtagttttgaatcctaaaggcaggatttttttcccctctcatttaaagcaaaacctttcattgccactgaataattatgcatttcttagactgccagcttctgcaacagtgattcctaggccccagtttgacactgagtgtgttcagttattttgaggaaagttacaaacgtttcaaattctctcacctctaataaaggtttaaaatctgccttttatggtgcctttttctgggttaacatattagttatctatagctgcataacaaattaatgcaaaacataccaatgaaaacagctatcttttgaggtctctcctgatgttgcagctgagatgttggctggcgctgtgtcacctgaaggctcagccggggctggaggatgtctccaggctcacctgtgtgtgttgagaggcctgagcccttcagtggttactgatcagaagcttcaattccctgccacatgtgccatgatagagaggtgcttacagcatggcagcttttgtcctttagagcaagaggtagggagagagagagagtccatgacttttttgagatagcttctcctattaacatctgatctcagtgtggtgtatttgttacaattcatgaacacacgttattacattacatttttattaaagcccatagtttacatattaattcactctgttgcatgattctatatttttaatgttttattgtaaaatacacataaaataaatgttaccgtcttaaccattttgaagtgtatggttcagtaacattgaatacattcatattgttgcgcaagcaacactatcacccgtctccagaactcctttcatcttgcaaaactgaaactctgtacccattaaaaagtaactcctcattccttccttccctagtccctggcaaccaacattctactttctgtgtttatgattttaactactcttaagtatctcaaataagtggaatcatgcagcatatgtccttttgtggctggtttcttttgcttagcatcttgtcctcagggtttatctgcgtggaagcaagtgtgagggtgtgaattaatcattctttctttctttctttctttctctctctctctctttctttcttatttatttatttatttattttgagacagtcttactctgttgcctagctggagtgctgtggtgcagtcttgactcattgcaaactctgcctcctgagttcaagtgattctcctgccttagactcctgagtagctgggattacaggcacccaccaccatgcctggcaaattttttgtattttcagtagagactgggtttccttatgtggcagtctggtctcaaactcctgacctcaattgatctgcgtgccttggcctcccaaagtgctgggattacaggcttgagccaccacaccccacccctttttaaggctgaatgctattccattgtatgtatataccacagttggcatatccattcatcttttgatgggcccttgttgggttgcttccgtgttttagctattatgacagttttatgggtttggacaaatacataatgttacccatccaccattacaatatcatagagaatagtttccctgctgtaaaagtctcctgtacttcacttattcttccctccctgctctccccctgcaggttcctggcaaccactcatctttttcctgttttgccttttccagaatgttatatagttagaatcacatgatatgcagccccagtaggttttatgacctagtctcagagtcaaacagtattatttctgccttattctgtttgttagaagcaatttcatccttctttcagggggagggtaattgtgcttcactacttaaaaagctggggtggtggggagaggagatatcaaagaattttcagacatgttttaaacaaccatagttaagatgacaagactagaagtccaagcattcactgggcatctattctgtgttgggcactgttctttcttagtgttttatatgtactattcattcaacccttacactaatgccatgaggtcactctcatatttatcatccacattttacggatgaggaaactcctcatccgtatgtgactccctgaagccacatacctcataagtggcagagccaggatgcaaactcaggtcagcctgaaaccaaagcctaagtcttgaaattatatcacgctgttcccttttagtgtaaggggaagtcttagtctaaggcttagattcaggggacaaggtctgaccaaatacatcagaagacatcaatgggcgatgatgctaaacatcttccagttgcctctccaaagacattctttgtccttcctcagtgtgtagtttccattgctgctggaacaaatcatcacaaacttaatattgatttcctgttttaaagttctatagctcaggaacccagtgtgttctcacttgcaatcatcagggtgtcagcagagcttcttaccttctggaggccctaggaaagaatccctttccttacttgttccaacttcctgagactgtcggcattccttggcttgtggcccctcctccatcttcaaagccagcaatacgggcatttctggtcatctccacagtctcatctcctggactctctcctacttttttttttttttttgagacagagtctcccactgtcgccagagctggagtgcagtggtgccatctcggctgactgcaacttctgcctcccaagttcaagtggttctcctgcctcagcctcccgagtagctgggactacaggcacacaccaccatgcccagttaatttttgtatttttagtagagacagggtttcaccgtgttggccaggatggtctcgatctcttaacattgggatttgtccacctcggtctcccaaagtgctgggattacaggcatgagccaccgtgcctggccctttctcttccatttctaaggttctccgtgattatactggacctatccagatagttcggaatcatctccctatctttaggtcagctgcttagcaaccgcaatccatctgcaaacttaatttacacatttaatttacagatatttacaggtttttgggaataggaggtagagatctttgggaatgttgattaaaaaaagaaactctggaagatatttaaagaggtttgttctgtgccgatatgagtgaccatggcctgggaaacagtctctggtggtcctaagaaagcgtgtctaagatgactgggttatagtttggttttgtacgttttagggagacagaagttataggcaaagacaaatcagtacatgaaaggtatacattggttcagcaaagaaaggcaggacatcttgaaatgggggtaagtagcctgcggcttacagatcatagttggattcaaagattttctgattgacagttgattgaaagagttaagctttatctaaagacttgaagctggtagaaagaaatgcttgatttaagataaggggggttgtgaaaaataaaatgcttagccaggcttggtggcatgcacctgtagtcccaggtacttgggaggctaaggcaccaagaatcgcttgaacctgggaggcagaggttgtgttgagccgagatcacatcattatactgcagcctgggcgacagagcaagattgtgtttccagaaaaaaaaaaaaaaaaaaaaaaaaaaaaaaaaaaaaaaaaaagataaggggcgttgtggaaaccaacatcttgttacgtaggttaagctttcagatagcaggcttcagagggaatagatggtagatgtcttgttttcagatcttaaaaggtgtccgtctcccaccgaatctgtgctagatccagggaagtcctggctgcattcatggaggttcttcatagattcagaaaagacagctttgcagggtcatttcaaaatatgtcaaagaaacattttgggatacaatattttgatttccttcagagtctgctatctgtcatgcgatgctatatcagagtcaggttggaattgggtatcttattcccaaagagtctgttttgtcagtctaatgatttctatttgaatgctaatgctgaagtcagttgtgcctaaactcaaaaagggaaagggcataaggaggtgtgtctgacctcccttttggcgatggccagaaatttcatgtttcaggtttcccttggcccagggggagtctgttcagtcagttgaagagacataggattttattttaggtctcctgcctttcctgctcttttcccaggaagccagtatggaaggagaactccaggggctcttctgccctttgattgtcagctgagttctgcttatggggagttttggtgggagattggagggaggtggttaaatgataccaaggcttctattgtcctgtgtccttcctgagtagcagagaggaccggcctctgcttgctgtcactaagcagccagcctcctttccttctgggaccctctaacttttccttcacctcagccattttggcccagggaaaataattttgctgctactaattctaggttgctgcatagcctgtgtggtttcccggtgctctgcctacacctttgaaaacagtattctgtaagtaagatctccttaactaatcctaatttgagtatgccatctgtttcttatctagaccttgactgatacagtgactgagggtagtcatatttgaagttaaaacagaaaaaaacaaaacaaaacaggtatgtcttgaattaggctaggctaaatctttcaaagcgtgggacttaaccccttgccagagatgttgatgtgaaccccgaatcctaaggtgctgtgttgttttcagaagccaagtgaaatttccacatgaaagcaaagctttgtgcgttcttaaccaagaaggtccttaggatgtatacagtgttctctctttgagttcctcctggtgtctgttacaacagatgaggaattcaagaacactgccccttccatattcgcaagatgtgacaggctattgcccttgtcttagaagacctgttttaggttaaaaaaaaaaaaaaaaattcaaacaattccacaggtgagctaatgagctaattacagagagtggtttcaaaacattggcattccacaagtaaacagcatctgcctttgattaaggtgtgaaattttaaaaaggtatggaaagatggctagtatcttcaggtggcttcctttatattttttattttttgattgtgcggaaactattatataatggccttctgtgcattctcctgtgagaaccaggaaaaccaaataacacataccaagatcctacagtggcatgaggcgtgaactctgaactgcctgtctgggacacagcctggtccattgtctgcagagctagggctttctcattgttccctcatgtttctgtactgttcgctgttttacctttagaatgagagttccctctgcatacatgtagaccaactttgtaaaattttgagctatttgtgctatgtcagtggctctcactattgactgctcattagaatacaggaagaagttttaaaaatagccatgatgcctgggctgtggccctagggactctgatttgattggtcttggatggggctgttcttaagcatccagggttcagaccaacggaactaaagcagggcttctcaaattttaatgagcgtgcaaatcacccaagactcttgttaaaatgcagatgctgattcagtaagtctagggtgggacctgagattctgaatttatgataaactcccgagcgatgctactgctgctgacctgtggaacacacattgagtagtaaggagatagaacatttgggtgggtacagataccttttaaggatgggtgaatgttaatgcttgggtgtttggtgatttgaatcatgactccgagagttgagagttctctaggaagtaggaaatttgtagtctaatttggatgatcgaattacagactcagtggggtcttgagtagcaaaacacagccagacctcttcatatgccatcattgccacattaatgatgagtctgtttattcattcatgcattcattcattcatttgttcattcattcattcagtgaatatgtattgaatacctgtcagacaccaggcatcttttcggtgctgagaataaatcaatgacaaagataaatgaggttcttgaccttggctattccagtgaatggagtagaaatagattaactcaactaaataaatatgagtcaacaagagccataccgatggtgatatgtaccatcaatgaaatcaagtacactgtgtttccttaggtggaaggtgtggctacagagtttaatttgctatgtcaatggagcggccaatggaagtttcttggaagaaatgatgttttagttaagacacacacacatacacaaaaccccagggaaagaccattccaggaaaacagaaaagcagggcaaaggccctgaagtaggaaaaagattgatttattggggaacagagaagggatcagtgtagccttggtgtcatgagtgaggagatgagttgtgtggagaggtaggaagggaacgtctcatgcagaggataaggactttgagtgcttttctaagcaccataggaaggcgtctgatggttttacacaaggaagaggaacattctgatttttgtgttaaaatgattactttggctgctatgtggcagatatattagagatgaagatgtcaaaagtggacacagggaaactgcttagtaaactcacagagtaacccaactgaatgatgatgatgcctggtcctagaaaagtggcagtaggaatggatatactttttgtgataacactgacagatagggggatgaggaaaagggaggaagcatgaatgacttctagcaaatgcagaaatagtaatgatttactcacatggggaggatagctgaagatctaatttgtagggtttgacaagaccccagggctccattttagacaagtttgagatgcctgttaaactttcaagtgcggatttaagaatacaatgtatactcgagtctagagcttagggaagaattcaggtctaaaagtaggatttgaggggctattcctatattcatattaaacattaccgtattaaatgagttctcaaggacagagaaaagtagataccaagggaatattggggtttgaagaaaaattggcccaaggttagggaggcaactttggatccttcttgaaatccatcttggctttggattctcagatcttagactcaaggtaaccttgcagagatttcaataataattagtatgtaaactttcagtaaacattatttcccagacatggaacatctggccaaagtcagtgtgatttgaaatgaagtcggctttatctagatgtctctcccagagggacacattgtgaggaaacagatattacattgggtgattatggagggtggggaaataagcttgttggttccttggccagatgtctaagtatatggtaacggagttaatggatgttggggaagaaagacatgtgcagagttggcatcctttcagccaagccaggcaaggttgctgatgaaggacgcctgctgctgccatggagctgaagatatattctcggacccaaggaagaaacacagaggatgcattatcatatggaatgattagttggctaatgagccttgaggggcaggaaaaaatggactataaaacaaattaaaccagtacctgacatcctaatgttctttgtaaacacatgatgatgtcagtgtgtgtgtatgtgcgtgtgtttcctcctgccagcccatgaggttagccaaccccacacaaatactcagaattaggctgaccatctccccattccccaagtctgattcctgggcaggatgccgtgcatgaggaaggtgatttggcttttagagagatcctttccctgtggttgttcttggtagaggatgaaagatgagatttctctgaaaagctcatccctttgaattgtgttcccgaggaaagaggccagatgctatgtgaccaaagctttagaaaactccaggattttgggtgatgagcatgcaatgcctggctgtcttccatctgcagcaagggcagagccagcagggaatggacaacaatacagagaagaaaaggaagcagggggtgagggatgacttgctcacagaccagattatttcatccccaaatggaatggttcagagtgaatgaaatcaccctgatacggagcaggggatgctgatttagctaccatgacagtgccatagccactcttcctgtattgactacttactacgttcagacttgttttaaaggtttttcactcattgactaattccacaccaatcagagcagcatggagggtataccatggctgtgcctattttatgcatgaaaaaaataagtgtttagagagataaagtgattttcttacggtttcacagaccgtaaagcttggactctaggattggaactcaggcagtgacatgtctgcatgttggaggcacattttgctacgttatcaaggaaatactcagttattaaaaagagagaaggaaatgcctcatgggaacaaaggccaggatctaaaatggttttaatttaaaataaatacagccatttgtgttatgtttaatatgtgcgcagcattttacggtaaaattgccatatctgatttgatttaatctatataacagctccatggggtaggtattatgatcctcattgtacatttgttgaagctggctcaggaaggatccttggccagggtcaggcagttcagcttggctgagcgataggatttgagttcagacctttgtctattacacatgcccttcaaatagtattctagtcagatttctttccaattatcagtgcttctgcattatctataatctgggatgtttatttttacttcaagaatctctcataaagactggataccagaaaccttccaaattgtgatttctcctgttctgcccctgaaacttcattatttaatgttcccggtaataataatggacacccatttctggattaaagtacgtgccttttcaaatgatgcatcgtggaaaggttattattaataaaggtagcattaaaacaccacaaataactctgtaaccttgcttgggctcaataaattccctgcagaaaattttatttccagcaaacccttaaaatttagctcgcttttaatatactgtgaccttcagtggcccttatcattcattatatacgagtgacctttccaaagttgagaaggatagttgcaacagcttttggatattaaaacctataagaggtaggtatggttttcgttcattcctactgataattaattcatgtactttaaagacatagcgttattccttttatgacacaggtggtgatggtttcataagggcatggaatataaatggttatcttggctaaagtgggtttctgtcctttttagatgctgagttctagctatagcatgactcagactggggtttcccttggaaggagcaatgtcaagctgttggagacttgatcatcattttgatgatcatccttgtgccattttgacgatcgaccccttacatcttctaacagctttttttttttttttttttttccttttttgagacagtctcactctgtcgcccaggctggagtgcaatggcatgatctcagctcactgcaacctcggctttctggggttcaagtgattctcctgcctcagcctcccaagtagctgggattacaggtgcccaccaccatgcctggctaatttttgtatttttagtagagatggggtttcaccatattggtcaggctggtctcaaactcctgacttcgggtgatccacccacctcagtctcctttaaaaaaaaaattctttattaaataaaacttaaagcatatttaaaagtagagagaatagcctgaagaatcaccttctttgaatcacccagattaaataattatcaaggtattgctaatcttactttacatatgccctggccactctccctctctagtctcatgctactagtcttaagcaaataccagatatcatatcattgttttcttaaatatttcaggttgcatctctaaaggataagaaggtttttttcctaacacctgtaatatctactaacaattaacagtgattttatgaatctcaccactattaaatagtggtttaattttccaattttttcaaaaatgtcattgttttcttatttccaattctaaaaatagtctttatttttttacagcagtttcaggttcagagcaaaattgagcagaaggcactgagaatttgcatttccccttgccccacatttgcatagcttcctcctttaggaacacccttcccagtggtacacttcctatgattgattttatgatagtttgtttatttgaaacaggatccaaataaaggcagtacactgtgattgattgatatatctttaaaaggccattttactctgttaaaaaaaagcttaaaacgtttttttttttttttgagagtggaagtcttgctctgtcgttcaggctggggtacagcggcgtgatctcaaaggctcactgcagcctctgactcctggattcaagcaattctcctccctcagcttcctgagtagctggaactgcaggtgtatgccacgacgcctgactaatttttgtactttttaatagagatggggtttcaccataatggccaggctggtttcaaactcctgacctcaagtgatctgcccaccttggccttccaaagtgctgggattacagctgtgagccaccgtacccagcctgtattaagcatcttttaatcagtctttctcccatatttttgtgtgtttgttttaacatttttctttgtggtgattgttgaccttgttgaagaaaacagattgtttgtcctgcagtatttctcacagtctggtgtttgctgattgcatccctgtggtgtgatttcacatgttcctgtgtcctttgtattcttttaaattagtctaggtcagatgcaagttccatttctttggtcatttcttcttccaagaagaggtacattgatcgattgtctccctttttgtggtgctatttaatctccatgggctaggtattattagctttattctacatgtgatgaagcatccattgaccatggatgctcaatgcatttttcaggggttgcaatttagtgacactgtaattttacccttccttcttcatggagttaccggagtacttcttaaagagaaatttcccagtctactattaggatagtcagggggtatagtttatacaggaaatacaggaaaaatgcttgattttctctttgtgatttcaaatatatgagcttgtttatttgcatactctagtgactggaatttttggttttactacaaatgcagggatggaagttattatctttgttgatgctcagattattcaatcatcaaccggtgagagcttcctccttcctcaagtttctgcagaagtcattttgacatgactctgcttgtctttggtggctttcttactatctagtatgacttgatattctagattcatcttgtatatttgctaccccacacctgaaataatccatttccccgaggagatctgttaggttggtacaaaagtaattgcagttttttcccattaaaagtggtgacaaaactgcaattacttttgcagtaatctaatagttcctaagggtatttcaggatcataacctgggtactagaggtgtcccatgaatcttaaaagagtcttatcatctgttcccccaaaaaccacctcctccagttaccatcatcttgataatcggcctctccatccatcctggtactcaggcaagagagttcagagttttctttctttccttttttttgagacagagtcttgctctgttgcccaggctggagtacagcagcatgatattggcttactgcaacctctgcctcctgggttcaagcgattctcatgcctccaccttacaagtagctggaattacaggtgccttccaccacacccaggtaatttttgtattttttagtagaggcggggtttcgccatgttggccaggttggtcttgaactcctgacctcaagtgatctaggtctcccaaagtgctgagtctctgtcacccagactgctggggtgcaatggcacaatcttggctcatggcaacctctgcctctcaggttcaagcaatgttcctgcctcagcctcccaagtagctgagattacaggctcctgccaccatgcccagctaatttttgtacttttagtagagacagggtttcatcatattagtcaggctgatcttgaacccctgacctcaggtgatccacccaccctggcctcccaaactgctgggattacaggcatgagccaccatacctaaccagcaagttttcttttatttatctttcttccttccagtccatcctttgatttttctttccagttccactgccagagtcagagccctacactccctcacctggaccgacaagtttgacgcctaataaaatggacttctagtcttgctctctctagtccagtccccatcatgccaaacaagcctgttttatgaaaaacaaaacagaacaggaaagcaaaataaaaccaaaactggtcctgccatgcccttgttcagaaatgttctgtggctttctgctccctagagaacaattcaacgctgctccggttcttggtgtccctccgtttccagtcccataacctgcttcttccttccatttccttcatagtagggatttatccctaactcttcttacttcgttcctgctgctcccatgcctgatgtccctgtattcctcttcccccattttgcccaaggtcacgcagaaatttatgccaaggctctcttcagatgattcttttttgtgatgacttccactgaccttggccagaactgcttattcccttgattttatttctttaacgcacagtttgcttagtcaacctctatacgccttggtatcctaatctgtaaagtggggaacataattataataatgcctaggccgggcgcggtggctcacacctgtaatcccagcactttgggaggccgaggcgggcggatcacgaggtcaggagatcgacaccatcctggctaacttggtgaaactctgtctctactaaaaatacaaaaaattagactggcgcggtggcgggcgcctgtagtcccagctactcgggaggctgaggcaggagaatggcgtgaacccgggaggcggagcttgcagtgagccgagatcgcgccactgcactccagcctgggagacagagcgagactccgtctcaaaaaataaataaaataaaatataataataataataataataataataataatattaatgcctatggcctggggttgtgcaggtattagatgagatcgctcaagtaaaatccctaggagtagggttgggctcctttgtgagctcttcataaatattagttcatcatcttactgttgttagcagtaataatgtttgcagtggtaacatttctttacatctctattaatatcaccacatctcagtaattttacctggatcttgcattttctttaaattgggaagtttttcaggggaagggtctcatcttagcaattcttccttttaacacttggggctgagcggtaccttacacacagtgaggcctccgctattatttgcaaatttttgtgccatggatgtagcagaaattatccgagggctcctgatgtaactcctgcccccaatcttgcatcttagctggaaacaataaataacggaataatattgtctggtaccaaagggtgtcccagagcaggaattgcgcagagagcttgatgaagcagaaagaaggaagagtggctaacacaattagtgagtgtctggccctgaagaatggattgtattggacagaggggagaaaggggattgttctaggaggagagagagtgataaggtaagtatagaagtaagaggcagctgtcactgcagtggctgaatgtaaacaaagaaaatcatttagttgaatattagtgagtcaaatcaagaaaattcccatgtaatataacaagttttaggaaatgactattagtcacagttttatctaatggggaaaaatactgtgttgcgtaaatagtcataatcaccactattccagataaagttaaataaataaaacatttttctgcttgtaatctttccctacgtacataagagatcttcaggtcttaaatggcatttccagtgtcttagtctgtgcctcacttgtacaatcttaatgggacccccttaggctgggcacagtggcctgccccatacctataattctagcactttgggaggctgaggcaggaggatcgcttgagcacaggagttcaagaccagcctggccaacatggtgaaaccctgtctctgcaaaaagtgcacaaaaattaagcatggtggcatgtacctgtagttccagctactcaggaggctcaggtgggaggatcgcttgagcccaggaggttgaggttacagtgttggtgccactgtactccagcctgcgcaacagaatgagaccctgtttcaaaaaagaaaaaaagaaattaaatttaaagaaagaaataaatggcaccccttgagtgatggctgtaattgaggaaactgtcagtttgaagcagtggaggaagctaaagttatagtatctttcctaatagggtaaatttttgtttcatattttatttcatcctgctctgcttattaggaaacataatataatatgtttttttggggaggcagggaagaattataataattatggataatatttcaatttatgtaaataatagttcaacataaataatatataagtaatattctaattctgtaattacagcagtgggtggtatgttttgaggttttattaagtatcaaccattgatttaaacacattttgttgaatcccctaagatctccagcgtcaggtttcctgtctttcccacttgacagactaactccggctttgagagtaaatgcgaagtatatcaggtcaaattaagtctcaggtgagatctgtctcctgaaagataaacactgggttgacaccctgaccatgattcatattgggtctatggaggtgcaaactggagaaaaaaatcatgagtttcttcttgttgtcgttggtttagaataagtcactgtaatgaaaatccttcttcaaattttgtgtttctgtatgctgttgaagggaaactcacagatttgcacacatcttcacataagattcatcggtggatgttatgctatattggctactttttttattattattattatttttgagacagagtctcactctgttacctgggctggagtgcagtgacacaatcttggttcactgcaacctctgcctcttgggttcaagtgattctcctgcctcagcctcccaagtagctgggactgcaggtgtgtgccactatgcttggctaattttttgtatttttagtagagacggggtttcaccatgttggccaggattgtcttgatttaatttttagtaaatattgtcaggtgtccaatgcagaatcatgtcatgtgaggctgttcctttgcaggggacttcatgtgagggtagagtgtttcttgtggcatcttttttgggatgcaaaacttatcctacaggtcatttatagtattttggaatgagtaaaggctttttgctgtccaacggaattattaaaaagcacttattatctttctcattaaacgagtcatctgttcttctttcaatgcacttgtgtcaagtgagtatgacatgcaaggatttggagatacagaagtgaacaggcattgctgggcgcggtggctcacacttataatcccagcagttttcaaggctgaggagggaagatcacttgaggtcaggagttctagacccgcctggccaatatggtgagaccccatctctactaaaaatacaaaaattagcgaggtgttgtggtgcgtgcctttaatcccagctattcgggaggctgaggcaggagaatggcatgaacccaggaggcattggttgcagtgagccaagatcgcaccactgcactccagcttgggcaacagagtgagactccgtcaaaaaaaaaaaaaaaaaaaaaaaaggacgacgaattggacaggcacagttcctactctcatggaagtttgcagtctgagaagcgagacaaaaaaaagtgaaatcattgcgataaggaagtgtgaagacttcagaaggagcgatcacccagcacaaagctggagcaagggaatgaccaaagtaagatgagtacagtaaaataaatctaattttagtttattatagaacacttggcaaacacagaaaagtacaaggatgcaaattcctcagaatcccatggttacagtcaccttgagcattttactggatgtttgattttactaatcccctcttgatgagcacttaggttatttctttcctaatatatgaaatatctcctaattttgaaaatgtttcctctgtctactatgtgatagaatttgtttcatttctttgcactcaatgagggttcttggggtgggatagaggggcaaagtgggtagtttgggtggagctaaacaaatctaagtgatgccagtataaacggcgggaaaatatctgtccatagctgcttgtcatttttgtgtcagctccccaaggtgtttgtcagtgtctctaatctccttacactgtggtctcgcctgaggatttgcatattatggacaaagtgaatgtgggggagtgtagggataaagcaaggaaatttgacatttagctgtcaacgatattgtctttcaagtgaggttttggaatctggtaagcaaaagattctaatgagtttgaatgaactgatgagtgtaatacctgttttcctttctcttttcctcgatctctcattctgtctcctccctttcttcccctaccccttttctctttctgctttacccatttgtgtttgaatactggatctttatcaaggtcacattcatatatctcaagcaagggaaaataaaaaccttgtaatttatttatgcatgtaattgcctggcctcattccttttttatttctcctctgcttacttcctaattcctggtgggtctatagctgttaccaggagaggagactggcgtggtcgctgaccaaatcaatgaagatactcctttagagacaaagtttacagttcttagttgtgataagcattatgaaaatctaaatgaaattgtctaggagaggtacattatgaaatcacactcccttttgagtgttaatatggatcaacagtgataaatatttgagacactggttgactggacatgtgatgaagacttaagacttttttttttttttcttttttactctggaagtgagctgcatacagaaagaacaaagacggagtgcagattaataaccaaagtcctgatgtggcaattgattaaactctctttttatgatacctttcctctagagtgaaaagtgagtttgtgttcgtgaatgccctggtgacaagagtctctttttccccgaagaaagagattcacgtatggctgaaatttcccggagaacacaggaggggggggaatattgcaataaatcaagtgagtttttgtgatccctataagcaaaaacatacttcagttatgatggattgtgttagagagtaaattagattgcatggaggctaagtactaatgttgatatttacagtgcttaaatatattgtctgcctcctctaaatgcagctcattcattggctttatgttgtggaggaaatatcagaataatgacctgggttttttttttctgtctttatagtttaatatcatgcaactgtttattaataagctccaaaccccaaaggatccttctaatcctattctaatatcagactaaatttaataagatgcattcttctccccactgcttatgcctcattcattcatttattcaaccaatatttattgagggcttcccaaagtgacaggcctgggttaggctttgggaatacaatgttgaaacacgacaggcttggtctctgccaacaaatggggacagaccaaaagggaaaaagaaaaaaaaagaccaaagacactgagccaagaatgccgccaggcgtttaaggatgtatattgtttctctaatgtaatgacttcgagatttttgggagagatgagagtttagaatgcttgaagatgttggtgtccttggagtgcaaggattatctcctgggataatggaggggaaatttcttgcaattttctcattttgccaagcccccacccctggcactgttgaaattttatgagggtttgctatgggtttttttttttttttttttttttgaggcaaacataactttgttcaggttaccagaagtaggcaaccgctcagttgaattccagattcaggacaagatgtcttgctgatggtgaggtcaaagatgaggggaaatcttcagagagaaagcaagcctgaaggctgcacttcagacaaaggcctgacccgggttcttcacacttgaaaggatggcagagttcaaaggaggcagtgccaaaggagcaaacgcagacacacgggaaggcttgtgaaaagggtttttatttgaagtagagtttttgagcacgtgatggggtcgggggtggaatggagaaatgcaagtaacatgcttctttatcacagaaattctcatcaaagtcatttcctatcagaaatatgagtgtttattggttttcattaatccctgcccctattctctttctagccttcctttcctccttctttccctgccttcctccctcctcttcttcctccctcctctccttcctccctcctctccttcctccctctccttctcagatgtgaatgtgttaaagatccaacctttgctaacttcttgcactggcctagaaccatcttttagaccgtgtcattgtttatgctggtttagatctttaaagatacatctttataaaaagttataacattcttgatgacatcgaagcatttccagaaaatatcgagatccgtcttatatatctgtttattcatccatgcatccaccatccatgtattcatccatctatctacccacccatccacccatccatccacccatccatctacccacccatccacccatccatccacccatccatccatccacccaccatccaccaatccattcactcatccatacattcacccacccatccacccacccatccaccaatccatccacctatccattcactcatccattcattcacccacccacccaccaactaattatttacccatccatccacccacttacccactcatttatttatccatccatccatccatccatccatccatccatccatccatccatccagctatcatgtatacagtaattaaaacagcaccattttgcagagttgcttcactctagctttcttttctgtgaatctggaacaactaactcagactctgtagctggaaaaccaagaaaaatgaatgtgaaagaatgccacatctttgcaaaagcaaacaccaccacatgcactactattaatagactgctttctcttttcatattcttcctgtgacagtcataatttgcatatatagggttaggtttggcagaaaggaaggtagaagaggtgaataattcatctggacttggagtaaaggttttaattttctcttgaattcaagatgtcttttggaaatgaaggtggctctgaaggaagatcaaaacaaaaggtgagcaattctgatttcttccctaagcagtggccattataaaaataaattaaacctggagaactgaacaggagtgcgtggtatctcttgtgcaagagactagaatagggtgatttatatagagatgacctaatcaaaatctctttaatattattgcacgcaatataaacatttatataataatttatactaaagaaaatacatataacatgtatctcatattttgtttcactttaaccttctatttactctgtatatttaaatgtatttttaagtgaaaattagtgttttaaagggaactattcaaagttcattttcgtctatagggaggaatgcatgtgtttaaatgggttctctgagtaaatatatttttgacacttgaggttattcaaactgagcatctctcagttttaggtcttaagtttcttccttcttctatatactttgttttacttttagaagctgaaacagggcctctaccatctgtttatctatttcagccaaattcaccattcagataatgtacatttcacaactgaagcccactcagagatcaattttcaccacttaaagagcatttagccatgattccaggaatagaaaatgtatcctgagacccataatgacttgatgagagaataaaggatcatttgttatgcagcaagtataaaattataacaacatccccctatgtttacagatgaaggacattctggctcaggaagtggggaggattctccaactttctgacataaatgattggatgctgttctttcccactctgtttgttgtcttggaaacaaatataggatacattgtttaaaaaaataggtaactggcatcatttggccctaaaattaggattagggttttttttttttttttttttttttttttttttttttacgtataacaagaatggagaaacatcttgcttactaattggaaggaataagtttgttgctacaacgtactgagttttggctctcaaattctcctcttcttagccacaatttggctcagaggatttgcaccatttgttcatctgtaaaatggtgataataatagcagatactgtctaagtcttacagtgagatttaaatgagttaatagatataaaacacttacagcaatgcctagcacacagtaaatgttctagaagggttagctgtaatttttggttattatactcttaggagaagcttcctacaataaccttatgagacctgctctccttgtcatgcttttggttgacctttcacagagtgtattttcaggttcgacctctacgtcagcagttccatatactttgatgcttgcttcatgctttgcctatggtgttgtaaacaggagttctccacatgcatgtgttgctaagcaacacagaatcctttggctgcaagtaacttcaaaccactcgtactaccttaagacaacaaaatatcctagaaggactcagagctgtttcccaggattcaggggcagagagttcagtcatagaacccaagaggaggaagttcacacagttaccccagaagaactgaaaccaggaagggaacatctacaggagcagagattacactgtttttccagggctgcctggggttggtgtctccttctgtctgtgccattaccttccttttctctctgtagatttctttcccacatatggcacatggacacacggggctgccctgaacccagccctgcctactgcagtgattacaatccatgcattcatttacagttactgaggacagaacctggttggtccagccctgcccaccacactgattacgacccatgcattcatttacacttactgacaacagaacctgattggcccaggtcttttcagaagtcacccctagtccaatctgctggaccagaggagggtcatggttgctaacccacccggcagcagatacaggggtggattctatgagaaggacagggacccactatagcaattgattaatagatctagaaagtagtgtgcgaagttaccaaacatatatgcccaaataactaagctataataagcatgttcatcacttcagaagacacaactacaaccaatgggtgtaagcgacaagtggtcagatttcaagtctcaaagaataaatatctgaaaatagataattttcattatatgtctatataatgttttgttatatatctatattgtatatgtatagtcatcatatatgtatacatctattttcattgtataacatataatggtaatatagtatattgttacaaatatctgaaaatatataatgtaattattaaattatatgattatactatacactatagtatatgtgctatatttactataataaaattaagtatagaaaatgaaaattattttcagaaatttattcttaacaatataaataaatctctatggataaatctatgtacatagatttaagatatactatcatacatagaaaaaaacagtgttttcactttacactcacactcatatagcacagaatacttctgtgaccagatgtgcagggttttccccatcaacaaccagttctccagcagataccaatggggtgtcctataattcagtgccattctgacattatctacctggagatagcatcagatcccacagattaaggattctgccgccaagactgcccccactttggactccagttggaagcctcaggttgtgacctgtgcttctgaaggactggttaggattcccatgtcccttccctgggtttaagttgatcgagtggcttatagaactcaggaaaacactgacgtgcgtttactggtttattataaaggatattacaatggatagagatgaacagccaaacgagatgcatggggctgagcatgtggataggcgtgcagagcttccttgccgtctctgggtgcatcaccttctaggtagccccactagttaagaagctctctgaactgtcctttcaggtttttatggaggcttcattaaataggtttgattgattccatcattggccattggtgatcaactccatctttagcccccctgccctctcaagaggtcaagaggtaggacagaaaattcctaccctctaactagaaggtaggtccccctggcaaccatcccccatcctgaggctatccaagggtcccagccatcagtcatctcattaacatacaaaagatacccttatcactttggagatcccaatggttttagaagctgtgctccaagaaccaggttcagcaaccacatacatatttcttataaatcacaatatcaaattatatatttgtatctatatatgtatatataacatatatatctatagagattgtatatatgtatatatgttacataatatataaatatatataacatatacatatatacatatctatatgtatctatacatagatatatatctatatatgtatatatgtatctatgcatatatagttacatttatatcactatctcaagacatgtatctctttgactatcactgtgtggagatatttactcttaggaattgtctcatgtgcttctaggggcggcaaatatgaaatttgtagggcagattagcaggctggaaattcagatgagagttgatgttgtagtcttgagtctgaaatctgtaggccagctggctggaaactcaggcagaatttctgtgttacagtcttaaggcacaattccttctccagaaaacccatctttgccctgaagaacttcaatggattcagtgaagcccacccatatttttcaaggtaatctccctgacatacagtcagctgtgatgatagatgtcattcacatctgtaaaatactttcacagaaacacgtagatgaatgtttgagcaaacaacgggacaccaccacctagactagttaacacatacgctgaccatcccagcatcctttatcatcttgatgagcttgatcactttggagcagcaagagggaaagaaaactatcaaggcagaggctgccatgatcaccacatgatatgccaacttgctaagacattgagtttcaattgagtctcccaggccaggctaccttcctcatgatgaggggaacagggaaatcaatatgggttcattaacacttaatttaggttttccagtgtggagcatatcaggaagagaaatggcagacatattacttgtctcaagcattatccatcattagcgtctgttctctttctccgacacacacacacacacacacacacacacacacacacacacacccccttatatttttcccctagtaccttcctcactgatcatattgttctgttaacacccaccaccaaaactacatcctgggtcctctccacactgcagctctcaagacgatcgtttactctattatcaagcttaccatttattttattttcaggcggttgtattcattataatgccattagcatgagaagtggggtcctgtcaccagggcaaccaggagcacagagtgcacattccctccttagctgatgtcttgttccctcttgggtggactccaactgtgtctttgattcattccattaggtggtcactgggatgtagatgcttgacagcctccttgtccttaagttgtctgtctttatatcctttactggccaagatttctctctccagaattcattaatttattaccttttatttctgtaagcataacacatataatatttccaagcatatttaaccacatgattatatctttacaattcctataacctctaaccctctaatgtattattttatattacatatcttggtgcatttccctatatattgtacatattgtatgcgagtatgatacattccccttttggtcagtactaccaattaataacaagctccttactactgaaggtatttcagctacatgatcatctgtctaggatattatagagcctattcttgcattatgaaaggggttgaaagagatgacctatacgttctttaaaaatctgaagccctaggtttattccatatctataactgtcctccatgaatataattttagctacagtggatctctctaaatgaagacatctggagcattccaaatgcaagcatgagtgcaaaatgtctgcttgtagttttctataacatccttcctacctccacaaaattacttagaatttgtgaataatttcattaaatttatctttggggggatacttgattaagtagtactccaagtgggcaatgtagtaagcaaatccattcccacattttcttttcacataggcagaatacatacaattttcttttttttattattattatttttttagacggagtgtcgctctgtcaccaggctggagtgcagtggtgcgatctcggctcactgcaacctccgcctcccgggttccagtgattctcctgcctcagcctcccaagtagctgagactacaggtgcatgccaccacacccagctaattttttgtatctttagtagagacggggtttcaccatattagccaggatgtatacacacaattttcagaaggtcttttgtgtgtatgcttttgaataatatgcccctggatcttgcccctccatcaatgatttccaaacctgacattgtatttgaattgcacacacacactaacttggatgtagaaacatttcagatctcaagacatggagaatccgaatcaacaggtcttgagtaagacccagtatctgtaattaaaaattaaaaaaaaaacctccctacgtgactgtttttctatatatttcttttctttctttctttctttttttttctttttcttgagacagggtcttgttctgtcacccaggctagagtataatggtgtgatcctggcttactgcagccttgacctcccgggctcaagtgatcctcccacctcatcccccagagtggctgagactacaggtgtgtgccaccatcaccggctaatttttttttttttttttttctgtagagacaggatcttgctgtgttgccacggctggtctcaaactcctggtctcaagcaatcctcccatcttggcctcccaaagtgctgggattacaggtgtgaaccaccgcacgcggccctatgattcttatggatgcctaggaacactggggatgtctgttttcatacagctggtggtcacagtttcagtgctattgtgtgttcttaggtggtttgcttttcttgctggctttcttcatggtcatagatcatttcaaagcctctgatatatcattgcggtttccactcagtcctctgtctgtttcattcctaattaattactttgacatgcccgtaacctgctcagaaatcactgggggtttcttagcagatacagaaacaaatcttcatccttcaaactggatttcacgaacctccaaagtttcatttctcctcgtctttgagatgtgatataatgtggttagaagacctggctttgaattctgccccttcctctgtagacctactaagttccagacagtgtctctgtatcatctcatgtaatgcttataacagcctcatgggatgaatatccccattttatagatgagaaaacagaggctcacttagctaaaatcacttaaagcctcagtagtccttggggtctggattttgcctccgaggactagggttgtcctcatatgaagtgattgcctgccagtgtcaacagaaggattcctagtcttgataatttggaaagtgcgctaagcatgagatcttgagatatatttccgacttcaacactttaatggtagtattaagaggtataattgctcatgcctgtaatcccagcactttgggaggccgaggagggtggatcatgaggttaggagattgagaccctgctggccaacacggtgaaaccccctctctactaaaaacacaaaaattagctgggtgtggtggcatgtgcctgtagtcccagctacttgggaggctgtggcaggagaattgcttgaactgggggggttggaggttgcagtgatccaagattgtgccactgcactccagcctgactacagagcaagactctgtctcaaaaaaaaaaaaaaaaaaaaaaaaaaaggcataattcagacgtggcagttgagagggtaaatagaaagcactaattaaaaaaaaatccaatttctaagactgcagagcatcagctattattgaaaatgtagacatcagaagggaaaaaccctttgttcagatacagtgctgctaagttagatgcagctgagaaatgggaatacatgcagtaaggtggttatgcagtatttttcaacagtagtccacggttgagcatggatgccatttaaatacattatctggaaaaatgtacatagaacttacgatttttgacagcaggaactcattatgccagaatttggattctcaggatagctgagcagaaagggcaggtggaagtctcccgaaatagatgagtgtttggacaaaaatggcagcaggtatactgtgccaagcattggcctttgcccaggtgccgggtacgatgtcaaggatgcaagctgaagctggccatatggttctcagagtctctctgctcattctgccctccactcagaggtagagacatgggcttttctttatttgcagcagaaggtaattgctttagacttaacaggctgcatttgaccgttgactcaccattatggtgtattatgaaatgaagcctcagccttggtctcccagagtagggggcgggggagggcggcagggagaaagggtggtgcctgaactatcaacacggcacagtttaaatgtcaggctctgcaatttacaagtgatctgagattcatgggaaatgcaatggaaaagtcactgccgagtccctctccctcatgttataagattgagtgtgtcataaattttgtgcattgctaagttcatggtgcttctgtaagaagacattaaaaatagaactccttacgtcctcgattcttacctacagggcatgcaggccaaaagtctacacacagaagttaagctggtttttaatcctgtttttcgttctggggctgtactcttaaaagccaaacactttttcagagacattctgtgcccgatatagcttcattttgttaatagcagaagtgaatagaggcaaaaacaaaccaaccaaacaaacaaacaaacaaacaaacaccctgaaaatacaagcgaatgcctggataggaattcaaagtttcattgaaaataagatagaaataaatcactaaccgtacttgtcttacctgtgtgatgtggatattacataacttaatattaggtagaatatccaaactattttgatgaaatatgttgggagagagagattttttgtttcatcagagagaagttttgcttttccatgaaggtacagcctcagcttccctagagaaatctttctccatagaaggaattatctgcaaagggtgggttgctgagggctaaatccattaaaaccaatttgaggaagagctgttacttgctgaggatgggaaaaaaatatataaaaagctcattacctagagcaaaatgattgctttaggattaagaaattgacagttactgtttaattataccagcccactgaaaactcacagactaagctttctagacacttaagcatatgtgcatttgttattgtagcaattggggtaaatttatgatcataaatgccaataacttgaacagtatccaactagcctttgtgtgaataggtttattgtgttcattttacagggaaaacacagtctttctatcaatatgaccaagatttcctcgattttcttttattctcagagttctgtttaattgcctgcaatctttttgatattaggctcttcattcatttttttgtccattagtagtttcactaaggaaacatggttctgtagggatgcgaggctgtgtttcttatacgtctgctcccctttgggtctgagatcatacatacctggcttgtggtccagtgcaagctccctggcagcttgggaaatgcgtcttcagcagacttcagccttactttgttttcaggaatgtggcaggccaggtcgcactaacacagccttctgtaacaactgtctcagtgctgactgagtagttaaggtaaatattaaaagctgagagagccagtgcctttatacaaaggctggagtgtatcaaaagcctacctagagttgtgcctaggcctttcctgggccttgaagcatgacaaaataatgaaggaattcttaataggaaccgtttggggttaaacaagttttattggggttgtgaagatactccccaggtatccacaaacaagtttattcggggtttgaagggactccccaaacctccatgatttagcaggagacaagataaggataatcatcccagcacctggacccatttagattaagtaaatttactgaggctgcagaggaaggtcttcaggactcagatcttatagatgagaagttaatcacttacgtctttagaggaatgcacacttacaggtagacatatagcttagaagctgtataagctctggaaaactttctaattttaagttggtctggtgatatttcccaggccttctccctgtacccggttacaggaataaactcccttgtctcccagttcacctgcatcttattttggggcagtgagaataagcattccgacactcagtttggcccgggaacaggagggcaagacagcttttcttttgtttattgctttgttgcctgctacaaagtaggcgtttaataaacatatttataaaaaaaagaatgaaggaagggagaaaggaagggaaggagagaaggaagaaaggaagcagaaagagaggaaggaaggagcgagggaagagaaaaagaagggagaggccgggcacggcggctgacgcatgtaatcccagcactttgggaggccgaggcggatggatcacctgaggtcgggagttggagaccagcctgaccaatatggagaaaccccgtttctaccaaaaatacaaaattagctgggcgtaggggcacatacctgtaattccaactactcgggaggctgaggcaggagaatcacttgaacctggaaggcggaggttgcagtgagccgagattgtgccagtgcactccagcctgggcaacaagagcgaaactctgcctcaaaaaaaaaaaaaaaaaagggaggggataaagggggagagggagagaagaaccaccctactaagttgaagaaagctgagtcctgccttccccatgtcatgccaacagattgtgtctcttaaaagagataaacaagattaattttggcattctttattcaaaaggacctttagactcttctttctggagaatttcaaggtcatataaaccttccgcaaacttagttattttaggaagtaacagaacatttcactgcaataatgaagtggttataatcttacattaagtaactaagtagaagaaaattggctgggtgaggtggctcgcacctgtaatcccaacactttgggaggctgaggtgggcagatcacttgagttcaggagtttgagaccagcctggccaacatggtgaaaccccatctctactaaaaatgcaataattaggcgagtgtagtggtgcatgcctgtaatcccagctattcgggaggctgaggcaggagaatcacttgaacccaggaggcagaaattgcagtgagccgagatccaaccgctgcactccagcctgggtgacagagggagattctgtctcaacaaataaacaatccccccaaaaccaaacaaaaagtaactaagtagagtaaaatctactttcataattcaaattccatagaatggttttgtttttctttaaattctattgttttagaaaactatacattttttaaagtgtgatttgactagtaataatatgagaactttgtacaactaaacttttcagaaacaaagctgttgtacaaagatatgccatcatccctggggagattttgagtaaatattctgtatgtggctcccccaaagtatctaaattcatcctaaaaataatttcagggaagacgtcatgggagttaataattagggttgttattagctcttagcgttgagcattttaaaaatccagtgagtgcctgcattatttcatacacttcagattatctgccttttgcaaacacagctgaatgtagttcatcaaatttgggtatttataaagataagcatagcccaaactttcgtggttgctagggcacactcaaatatcccatttcaatgaagtctgacaagaagtcactcttgtttttagattagctctggtcacagaaagtaacacagaatgatacaaaacagcccgaagaagcagctggctatggagaggcaaattcataggtgcctttttttccttgttaaactgagtaatcaaagtttagcttttctaaaaaaaaaattcctggaaacatttgctcatatgctgtataacacaattttgaccctttatcattgcaattcataataaatgtattttttgtcctctagtttccccaagaagttagctcctaggtaataaaattatacacacacacgctcgccccccccacacacacatttgcactaaacttctttacaaagaatcatttgacagtagccgtataatttaatgtttttcatctaatgctcagaatgaagcacaatatcaaattatttttgaggttttcatcttgttcctctgattttgattagtgagcattttctataccctagtcactaaattgaaagggatcaccaaattttatacatgctaaatggaaattggctgggtgcggtggttcatgcctgtaaccccagcactttgggaggctgaggctggcagattgcctgagcacaggagttttctaccagcctgggtaacatggtgaaacctcatctctacaaaaatacaaaaattagcgggacgtgtggcacatgcctgtaggaccagctgcttgggaggctgagatgggaggatcgtttgagcccaggaggttgaggctgtactgagctgagattgcaccattgcactccagcctggatgacagagtgagaccctgtctccaaaaccaacaggaaacaaacaaagaaacggtaatgtaaccttgacatgtaaagggcagaaaagaatttttacaaaagatattttattttaaataaaaatgggtactaggtcgaatacttgggtgacaagataatctgtacaacaaaccccaataacatgagtttaccgatataacaaacctgcatgtgtagtcctgaacttaaaaaaactgttttaaaaattaatgcttcatttggtaaatcaaccaagatagctgcaaattagtctagagtgaaaaattgataaacttaaaaatcgattaacacattttaagggcataatatgatattgttgactataagcactacgttgtacagtagatctctagaactaattcatttcacacagtgtaacttcaagctaattgaacaaccaccgattgtcccctccccgtggctcctggttaccaccattctcccctcagcttctatgagcttgtctattgcagacactttgtataagtagaatcatgcaatgtttatccttctgtgactggcttatttcactagaataatgtcctccaggttcataaatgtacaaatgtcaggatttccttcttctttaaggctgaataatattccattgtatgtatacacgacattttcttcattcatttgttttagtcagttctcacattgctaataaagacatacccaagactgggtaacttacaaaggaaaagaggtttatagactcacagctccacagggctggggagacctcacaatcatggctgaaggtgaaggaggagcacaggcacatcttacatggctgcaggcaagagagcttgttcaggggaactgccctttataacatcatcatctcatgagtcttattcactatcagagaacagcatggggtaaaacccacccccccatgatccaattacctcccactgcgtccctcccaatacatgtgggcataatgggagctccaatttaaggtgaaatttaggtggggacacagccaaaccatatcactgttcatctgtcattggacacttaggtggcttccatattttggctattgtgcttaatgctgcaaaaaaacataggagtgcagatatttctttgctatcatgacttcatttctttgtatatgtacccagaagtcggattgctggatcacctggtaatcacatttttaaatttttttttgagaaacatttatactctttttccatagtggctacatatctacattctattcagcaatggcaaaagggttccagtttttccacttccaggccaacaattgttttttttttttaatttttcatttttttgataataggcattgtaacaggtatggggtggtatttcattttggttttgatttgcatttccctatgtttagtgagctgtattatgggcttaaaatttgctaagatttccctttgttaagtgttcttaaccacctccatgttaagatctcatagtaaatgttcttaaacaccctctaccccactccacatgtccaaataaagggaaatttttggatgtgaaagataggtctgttcctatgattgtggggatggtttcacaggcctatgcttatgcccaagctcatcaaattgtatacgttaaatatgtgcagtattttgtgtgtcaattatacctccataaaaccataaaaatctataatattcttatgtgaaaggctagtgtatttatggacatatctcagacacattttgtgactagttatgatgagtcagaatttgcatctaatgaatttctttaccagtgttgtaaattctcagaattagttacataccctaatatctaatgggggttggccacaagttgataactaagccttcatcccttaatatcatctactccactgacttccagggctgagatgaactactcacagcatgcatatttaagacaaaaatgactctgatgagcaggtattaggttggtgtaaaaggaattgaggtttttgccaaatatttttgcaccaacctaataaaattctctcttgtatctgggatgggtcatgggccccagagacactgtaggtacttctatctcttaactttgaattagttcaatctaatgtggcatttgggaactgaaaaaccaaggaagttcattactgctattattattttttccaagtgtatgctaataggaaaaactgcttagcccaaaatacgtgtagcatgttgaattagctgaagcatttcccccgtgtttgctttagaacgtaatacacttccgttttggaagtaaaatgacaaatttttggtgcacaaacatgttaaaggctattacagaaaatatttagaatgcataatcttcctggattcctattttattgtaagtgtataaattttaatagagtttttatattagttgttcctcccaactaattatttttaaattgctggaatgttttgaagcagaaccataaaaggtatatattttttttatttgatagggctctttcaactgcaggtgatagaaaagcaattcagcaaggttaaatgaaatagaaattggtggagggcctggaggtgttacactatgggtactggcttaaggcacagcatgatccaggagctcacatcagtgtagtgaaggttcttttctttttctgagacagagtctcactctgtcgcccagagtggagtgcaggggtgcaatctcagctcactgcaagctccacctcctgggtccctgccattctcctgcctcagcctcccgagtagctgggactataggcgcccgccaccacgcctggctaattttttgtagttttagtagagacaggatttcaccatgttagccatcatggtcttgaccttctgaccttgtgatccgcccgcctcagcctaccaaagtgctgggattacaggcatgagccacagcgcccggccatcaagcttctttctctctccccctctctgtttcttgcacagctgtacagactttttgtatgtagtaagcatgtttacctgtgactagtaattccagcacaaacatttcacccccttatagctctgcagatattttctggaatgactggagatggcctgtcttcagtcatgatccatccctgaaccaatcatgataaaatctctttggttggttctaccacatgcattaatttctgctagagcatgggggtcctgtgaaggaaccaaatatctatgatgcttgttaaagacagaatgaaagactttactcaagagggactatcgtgataggtgaaatggggtcttgcagtgggggagaaagattgggctcaattctgaacgcaacaaccaaaagtggtgatttatagccaggaagtcaagtgagggtcagtggatggagacagcagaggtaagggaggattctgagtaaatgaactaacaaggttcttgctaacactggacaatgcagaggcagcacagaagctcaagcgtcaggcctcacggggaaaaggattcagatgagtctgaaatatgctgagtttggtggcttacgtctgtaatttcagtgactcagaaggctgaggtggtaggactgcttgaggccaggactttgagaccagcctaggcaacatagcaagacaccatctctaaaaaagataattaaaaaaaataaaagaagggtctgattggagtctggttaaggagaaaatctttgtcagtgcccaccctgaatatctggaacacgaacctccagaacagagagggggttctttcactagagaagctggatggtcaataataaagaatatccctgcttctggtgctcccatttatcacatgcagggaatgaaatttgcagaagtgacatgacttgaacaacgtcagacacgaagcatggaggtgaaattaaccaaaaggttgaagttaaaatgagtactttgcaatgccattaccgatgcataaactttgatgagctttgagaaataagatcaccacattttcatctacttttccagggaggtggaaaataaatagagaaatactcatttattcatctgtttaacaaacatccattgatattctttatgtgctaggtgctgtgataaacactacagaaatagcagagaacaatacagagaaaaagccatgtcttatgaatcttacattcttatacaccatcagaataaaatactgctttagaaaatatactgtgtaccttataataatagaacacaatctgttgtttctgagatgtgaaaagtcaattgtaagatttacgccatagaacaaagatgtaattcttgttacacatacacacacacaaagacacacatttaatcagggcataaatcaagatttttgtgatattaatccagtgcattcaatacagagttggataatctgttgctatttcaaatgtagttcctccctccttaaaatgattaaatcaaagtcccagaaggaacttggggaacttctaatcggtctccatgtcgtggacaaaaattaactgaattaactgtaactatctcaaatcaagacacacaataataaccactgtttattctgtgcctgccagtcactgtgcagataatttattgtgcactgtctcatttaatgcttgtggcaacctaatgaggcaggtacatttgattattagtcccattttacagtagatgaaacagaggcttatcttctgtaaagaaaattgctcttaaaacacagctcttggccgggcgtggtggctcacgcctgtaatgtcagcactttgggaggctgaggagggctaatcacctgagtttgggggttcaaaaccagcctgaccaacatggagaaatcccatctctaataaaaatacaaaattagccaggtgtggtggtgcatgctctatcatcccagctactcgggaggctgaggcaggagaattgcttgaacccgggaggcggaagttgcagtgagccgagattgtgccattccactccagcctgggcaacaagagcaaaactctgtctcaaaaaaaaaaaacaacaaacgcacaaacacacgcgcacacacacacatacacacacacacaccccacctctttgggttacatatgctttttaactgtttgaccttcggtaggtcagtaggttagcgagtgcccatgcagtgtttgcctgagcttttgcatcagccttgcctgtttttttgttttttgagttagggtcttgctctgtcacccaggctggaggacagtggtgcgatcatagctcactgcagcctcgatctcctggcctcaagtgatcctcccacctctgcctcccagtcttgccttttaagagccttaggactcttaacctgggaaatctataaaattttttgttatgtataaggaagaacacaacttttcttctgtgagtactgcttcaaagacacagagtccaatgtacataggcaggtggatagacaagctcgctgtcaaacttgttacatagatgaaatgggacagatggggtcattcatctaaagggttcttggtaaaggtacaaaaagcaaaaccatgaggccaaaaacgggagcagaaacagttggcactcagtgagtaggctccaaagctctggctcaaggtgggaacatggaagccaatggtcaagtttgttgcacagtgcacttaataagatgaacagcagtgctagaatctggaggatcatcatccctggagcttgacagccaatatctagcctgcttgagagtgcagatgaagcgctcggcaaatgtagttttatttacagcttcgtaagcctagatgggtaatcctctgtggtgtcctttagagggaaacgtaaaatggggatgacgactttaaataccttccagagttagatggcttttagacaccaaagttcagcctcttgcaacatattgcatttcagcccctgccacggttctctgctgacatttcagagatgggcagacaccatggcattgcagttgacatggcagcttggccaggtaggagctcacatatggagcatttcttgctttaggtgttaaaaaacaagtcatatctttaaaaggtcaccgtggtttgtactaactatatgactattgaaaggcacagtttggggcaagcctgtttattatttttcaaattagagaagtgatattgcgtcactgctgcgaaccaggaagggagaatgagaaagaaaatcacccatgaccaccaccatccctcttggaattgtgtcgtgctctctagcctccttcctttaagatgatggtttctatggaaaattgctcttaaaacaaacctccttaagttatatatactttgcaactacatggtcttcggtaggtcaaaaagtgcccatgcacttttcccctgcgctcttgcgtcaaccttgccttcttttatttttacttatttatttatttatttattcatttatgtatttatttattttttgagtttgggtcttgctctgtcacccaggctggagtacagtggtgcagtcatagctcactgcagcctcgacctcctggcctcaagtgacctcccacctctgcctcttagagcttttgggagcttgcatgatatgacggttgtgactaatgttaggaacatccaaggagtagacattggaaggactcctctcatgccaccatgagctgttgcccccaggaaatgagtgaagtctcagtaaaatggagagaactttaattcccgggtagatgtatctgaatctgagactgaacattttgttggtaacacaccagttatcaggagtgtcttgatcatgctcatctttgtctaatctttagatttctcatctttccggggaggttaagagttgctgtgtcctttctcagtcccaccacttgaacatgtggtaacatgtatgaggaaatgctttgtacataacaaatcatgtgaaagtaaaggattgtcgtcatttttgccattgctattaatattattacacagggtttctagtatattatgttggttaagagcaagcctctagagcaagcttctccagcccatgtcccccacagggtgcatgtggcccgggacggctttgaatgttgtccaacaataattcataaattttcttacaaccttatgagacgtttttgggggatttttttttttagctcatcagctgtcattagtattaatgtattttatgtatgacctgagacacttcttcttccgccgtggctcagggaagccaaaagactggacacccctgttctagagccagtcctaactctactcatttctacctagctgtgtgaccttgggcaagttagttaacctctctgatcattggcttctcctttagatgctgctgcatttttacctctctcataagattgctgtgaggaggctgagacaaggcagggcatcgtgcttgcagcaacaccctgcacgtagcaagggtaccacaaatggtagctatcaatgttgttatttgatgatccagaatatgtattgcttttgtcatcctttccctagtctttcatcattctggattttccatgtctttaagtttgttgctgtcttagaattagtagattttcatggttctaagactctatctgaaaactgtgcatggtggatcttgttaatgtggtaaaaatgtcatctgtcacagcatcccagttcatgatttaatttatccttccacagatagcctttattatattagcttgtagtgtatatttaatgaactagtgtaaaagtcatttttctctggctgggtgcagtggcttacagttgtaatcccagcactttgggaggctgaggcaggcagatcacttgaggtcaggagttcaagactaacctgaccaacatggtgaaacctcatctctactgaaaataaagaaaattaccagccgcattacatgcctgtaatcccagctattcgggaggctgaggcaggataattgcttgaactggggaggtggaggttgtagtgagccaagattgtgccactgcactgcagcctggacaacaaagcgagactctgtctcaaaataaaaaataaaataaatagggagatagggtcttgctctgtttgccaggttggagtgtggcagtatgaatatggctcactgcagccttgacctcctggcctcaagtgatcttcctacttcagcctcctgagtagctgggaccacatgtgtgtgccaccatgcctggctatttatttttatttgttttttactttttgtagagatgaggtcttgctgtgttgtccaggctggtctcaaactcctgggctcaactgatccaccagcctcccaaaataagctaccactcctggctgtaaaagtccttttgaaatggtacaggagttcaagaccagcctggacaacacagggagaccccgtttctacaaaaaaataaataagttagccaggtgtgatggcacacacttgtgatcctagctactcagaaggctgagatgggaggatggcctgggctgagcagttgcaggctcgttggagctgtgattgtgttactgcactccagcctgggcaacaaagcaagaccctgtctcaagcaaaaaagaaaaagcctttttcttgtaatttttaaataattccttccaatacaaaataataagtgtctagtccattgagaattaatttagaatgctcatgtgtcttggattgactttcaaaaccctgattcttaaaccatttgtgattgaggcttacaaccatgtaacaatcctcctaagttctgggagtgaatttaagtctggtaatgctattaaggaaagagagaagagtatgttttctaatgtacagtggatatcttgaagggagccatgcaggcatatttccaccttggtgtgtacttgatggggagaggcaaggagagagcgtggcaggttcagggtttgccatcccaatcttcccttggcgctgatccgtggtttccttcctgatcccacagaataagcaatgttgatctcgtgtggatcatctgttatgtaaaggtggttaataccaccattttctgcttcacatgaatcagagaacctgggtatctctgaccttcagggttccagctctcacctaagttcagccagtgtgtgaatcctctattgacctactgggaccacttggtagattgaccacagctcctgttatgcaccaagcattggcctgtgtgctcttgccagcaaaacaggtgtgatcctcagggagcctcaagtctggagggggaggcaaacattgattgaagaaacttacaatgaatgcataattaagatagggatatttactgcaaaggaaaaataaaaagattctttacatcaaatgacacatagcaccaacttgggctgagttggaagtgactcgtttatgaacaggggtatatatttttaaaagatgtactcttctctgaatgaataatttattaaatatgaaaagcaagagaaatactattaaaagaatgccacatttttagggaaagtgttgttgagggttcgaaacagacttttggtaaccggccaattccacaggctggtgccacattttcagtgccctttgatgtgtgtacgtgaaaaagctgcttgttttcctgtttaatatcaatctattaattttaaagtatttgaagagaaaatcaaagacatagtctgcatttggaaacacccagaaccacaaatctaaatcctagtaccaccaatttgaagactgtttgtcatggcttgaagcctcctgagaggggaattttatttacttgacggagtcatgtgaggttgattggtctaataaaactggattttaaatgaatgtggagcatggtgtccctttgccctgggtatttaaaaatagaccaatgatttctcatagggcgtctttcagatacactttagcagactgatgaaggctgttcccgggacacatttaaatctgaaacaaaatgagagtttaacaaggtgtgttggttcaggttaaaagcgcctacccctttcagctcagccaagatcatctctcattggacaaggttcccccaagactggctgggctcgtcccctgggtgctgaaatgattagtataacattccggagttcaggtctctgttatcttgtttctctgtcggatgcctgggaatgtgaatttgcctacacattttgagacatttttacactaggatgcttctgagctgaagatgaaggtggttggttttcttcctcctcttccccttttcaatattgtagggaccaagtggtttgttgctctctgctgccccctgttgctcatgaatgggaacagctggttttccactgaaggtgattcttaaccattacaaagagcttcccgtgaggttgaacctggggttcctagcttcatgtgaggttggctgattttatttatttatttatttttgaaactgacttttaaatgaaagttgagctaaatggggaagaaggtatctagcaatagcagaagtcccaaggttaatggaatacccaaagaacaaagtgaacagccgtgtgcctctctttccattgttggtagattccagctacctgcagctacgcttggtttcttgagagtcctagtccttgtaattgagccctggagttaagtccatttgaacaaacatcctcctagtcccaatttattccaggtcctgcatgagtggctgggattttcaggaaggagggattatagtcacatggtgtgtggttaatattttgagtgtggagtcaaagcatagttttgaatatgagcttcaactgttttcaaccgtatggctctgagccttggtgtctgtgtctgtataatgaggattttggtggtacctgattcagaggttgttgtgggaaccaatgagaaatttaaacaacttatgatttgttggtcacttaccaataccagtgcttttttttttttttttttttttgagatggatccttactctgtcacccaggctggagtgtagtggtgcaatctcggctcattgcaacctctgcctcccagattcaagcgattctcctgcctcagcctcccaagtagctgggattacatgtgcctgtcaccacacctggctaattttttttttttttttttttttttttttggatttttagtagtcatggggtctcaccaggctgatcttgaactcctgacctcagagtgctgggattacaggtttgagccaccgtgcccagcctccagtgcattttaggcactatgcttttattagctttttaatcctcagtaggacagcaaagatgcttgtcttttccctttcaaatagggctaagggctaacagcccttagcagaccttctctttatccccttgaccaggtttgtatcacatgcctgtgcctaaaccaaatgctggcaatagggacggaatgataagctttgctttgattagttagaatgattcccaaggaagggacaatgttctctgagcacacagagaatgatcactcaaatagaactagggctgaggcaggaagagagaataccctgaggatatcagtttggcttgtaactagcagggcctaccttacatagctgcaagatgatgcacttggacccaatagcccagatcccacgggtgtcataggaagtgcttatcacggagcctagcccatagcacccctgctctacagactcacccaatcactgctctcaagagggtcgtgctgtaatggggaagactgatccatcagcaaatttttgtttgtgtgtttgtttgtttgtttgttttttagatggagtcttgctctgtcacccaggctggagtgcagtggcatgatctcggctcactgcaacctcctcctcccaggttcaagcgattctcctgcctcagcgtcctgagtagctgggaccagaggcatgcactaccttgcccagctaagtttttgtatttttagtggagatggggtttcaccatgatggccaagctggttttgaactcctgacctgaagtgatctgcccgcctcggcctcccaaagttctaggattacaggcgtgagctattgctcccagcccaaatgtttttatactaaggtggaacatgctttattagctgtagtcacagacatttatggagactcagaagatccctcatatttaaaacatgtgttcctagatatgctgttgaagtttatttctttcaactgcatatcattacttgctttcatgctctctttggtccatttttggttttggttttggtttttgagatagggtcttgctttcttgcccaggctggagggcagtggcacagtcacagctcactgcagcctcaacctcttgggctcagatgatcctccagcctcagcctcccaagtagcttggaccacagacgtgcgccaccacgcccagctaattttttaattatttgtagacacggggtctcactgtgttgcccaggctggactcaaactcccaggctcatgcgatcctcctaccttggcctcccaaagtgctgagattataagtgtgagccaccagacctggccccccttctttggtctcaatccctcaactccaatatagcccttttcacccaccttcccatcttctctaaccccgggggacactggcaatctttaagcagaagaattggctgcctgaaagcctgtagatttatttggaggatgggtcaagaagaagtctcccaaaggagcttgggggaattctccttttgattttgttattcaaaaatgatgtcaaattttagaaaatgagagaaaatttagtagagtataacggttaaagagtctcaactttgctactcaacactttttgaccctgagcaacttgcacttaggggcctgagcttttcaatctgtaaatacggccaataataatacctccctcttagggcactctgagcagtcattgagagagcacgtgtaaagtgtttttgcacagtgcccagaaatttgcagtatttaatggtccttcctccttatttatttttattacttgtttttgtttttttgagacagtgtcttgctctgtcgcccaggctggagagcagtgatattatcgtgactcacggcagcctcgacctcccagactcaggtgatcccttcacctcagcctcccaggcagctgggaccatagctatgaacaaacacgtccagctatgttttgtattttttgtgaagacggagtctcaccatgttgcccaggctgatctccaactcccaggctgaagcaattcctcagcctctgcctcccaaaatgttgagattgcagacaaaaaccactgcacctggccccttcctcattctttttgaagtattttagctttcaaaaggtcaaggaccctttataacggtttgctagtttagaaagaaaaaaaaacagtgacatggtgaaaaagtaagcctgctctctctctcgttttctatgatgctctatcgggattccttggttaggagataaggtcaggcattctagggtattcagagggcccacctcttcatggggaagcccaggcttgcttgttcttatgttttgcaggacaaacgtcttagaactccacagatggggagtctgagaccctgagtgattaagtaattttgaccttgagctatctatttgacttgaagtggctaatggccagataagtgctctgagatgatatctcagtttctgctatttttcttgtgaggaaaaggaaaaaaagagcttgatagtgatcagagttcatttgcagaagtggtttccttttccccaatcaacttgtgagaattcacttctgtcctcagcgtgcgtgcttcattcattcactcatccaaagctgtctcaggcagagtgctggggactgggtgagggcggggagtctttccttcaggggcttatttctgctactgtgcatgttcttcctccacaacttgcagatccagacctctcctcctggcaagactttctcatttctttcacgtgacttttggttagaaacattggcctgactttgaggcttacacccagctttctttgtttgtgttttgttttgtttttgagacgcggtttcgctcttgttgcccaggctgaagtgcagtggtacgatcttggctcactgcaacctctgcctagcgggttcaagcgattctcctgcctcagcctcccgagtagctgggagtacaggtatgcgccgctatgcccagctaattttgtatttttatagagagggggtttcaccatgttgatctggctggtctcgaactcccgacttcaggtgatctgcccgcctcggcctcccggtgttgggattacaggcgtgagccactgtgcccgaccctcacacccaggtttttaggatacccttggttctatgcccctgatgacctgaaggcaggcaggagaagtagcagtgtgtgtttgtgtgtgtgtgtgtgtgtctgtgtgtgtgcatgcgcgcacgcacatgcacgtaaggggatgatgcagcccgtggcgcttaaattctaccctccccaagagttgggtcccttcaccaaacattaattttttccgaactccatcttatctctgtaaaatagaagtgctgattctttttttttgtttaagttctgggatacatgtgccaaacatgcaggtttgttacataggtaaacgtgtgctgtggtggtttgctgcacctattaacccgtcacctaggcattaagccccacatgcattagccatttatcctgatgctctctcttcccccagccccctacagaccccactgtgtgatgttcccctccctgtgtccatgtcttctcattgttcagctactacttatgagtgagaacatgtggtgtttggttttctgttcctgtattagttttctgaggacggtggctcccagcttcatccatgtccttgcaaaggacgtgatttcattcctttttatggctgcatagtattccatggtgtataggtaccacttacctagtaatagacaagcacatgcattgggtttgaattttgcaagtgagttgttggaagggaacccctagatgtcatttgcatgctaagtgctttccccgactgtgttatttgctgttcacccagccccgtgcattccatctctcacatttttcatgcgagtgttctgctgcccaaagttactctgtatagtgtttaatccactctgagtcagttctgcagagcagtcggtggtaaagtcctttcaccagcactgtctgagagttcctgtgacaacagcatccccgttcattgaggcctgagtgttcttttagattcctgcttaaacataaaccagcagtgaacgaagaatctttagtacctgacgtgaaatggagcccaagtctatactgctgactgggctgggggcgcatgcttggttggggttcattatatctgaactcatatcagggagatgatttactgtttctcaataaaagatggagttttgaagaataccttcttttgtgtgggatggaaacatgtggctaagcctattgcatcaccttgtacaaaagagatattcagcaggtatttattaagctaaactgaatcatgctcaaagacgctcctcttccctaagcaccattcagttgaatgtaacatgaaagagacaatgcatcatgttcattctggtttagggtctttccttgttgaaggctttctgctgtttagagaaagaccaagtatagcagccagaaaaacacagagctggcaactgagtcacaaagctgtagcaacacatcactcaagaggaacccttctcacaatgggtagatatacattgagtggtgatgtggagtgagacggattgatatccacaatgtcccaaaaggaaaagagacaaatttgacagtaatccaatttccgtcagcaaatttagatgatgagatgaaaagttagatttatgaggatagattcattctcactaggtattatgacgttagaacgcctgccaggtgaaaagtggcacatttttaggggaatttaggtccaacgaaaaggtgtttccttaggcagaaattgaaacatgatctgtctgtccagagttttgtgccttcgagcacacatgtgcatgcaagcttttaattaaccaagaagttcttctttaacgtttatatatatatatatgtatatgtatctacagaaataggataaaaagaagttcagaattcaactgtgattccaatatccatagataactattgctaacactttctagccttttttctctatgtgtatacacatatttggaaatttggaatcactgtaacctgctttgtcttaagatagcatgagaatttcttcatgctataaatgtccttccgaagtgtaatactttaaataactatatactgttccattgtatggatgcagcataggaaactcattccccttggctggatatttatcttactttttttttttttttgagatggagtcttgctctttcaccaggctgggtgccgtggcgtgatctcggctcactgcaccctgtgtctcctgggttcaagcaattctcctgcctcagcctcccaagaagctggggctataggcgagcaccaccacacccagttaatttttgtacttttagtagagatggggtttccccatggtggccagaatggtctcgatctcttgaccttgtgatccacctgcctcggcctcccaaaatgctgggattacaggcgtcagccaccacacccagccttatcttatttcttgtataaaaactcctgcgtgtgtgtgtttgtgtgtgtgtgtaaaacttttattctaatcaagcatattttcacaatttctacagcagccacaacaaactttctacaaggtgaattttagagagaagaggttcaccgtctcgttatttcaacctcatcatctgtaacggtggccatagaacctattctgatttactctaccagaaaacttaccctcttagttactttttttctttcattttttttttctcagctgtattgcctcagttggatcatatctgtttttcctcaggaatgtttctgaaactatgaacaatatggaacatgttgtcaataagggtattttcacagatgcgtttttgtcacacagtgtttattgccagagaagtatgattagtcatgttctctgatgtgatttagtaattgtcatttgtctattattaggtgaaattttctagctgaatttttccaaagatgaataaacaaattaatcattcactttcctatccaccattcaaccatccatgcatcctccctcccttccttcctcccccttccctttccttttctccttccttccttccttctgcatttattaaataccaactctgtgttaggcagtatgttgcatgccaaagacaaatgtataaactagatagaatggtggaatgctttccttctgagcactcacattttaatgctgggaattttatgctgaggttcagtgcttttcagggagccatgaaccccctgcaatgacttgcagactgtaggtattacatgtaaaacttgtgtgagtaatttcctgaagaaggggtttcattcttcagatcctcaaaaagatctatgatccggccaggcgcggtggctcatgcctgtaatcccagcactttgggagaccaaggcgggcatatcaggaggtcaggagatcaataccatcctcgctaacacagtgaaatcccatctctactaaaaatacaaaaaattagctgggtgtggtggcgcatgcctgtaatcccagctactcgagaggccgaggcaggacaacagcttgaacccaggaggcggaggttgcagtgagccaacagagtgaaactctgtctcaaaaaaaaaaaaaatatatatatatatatatgatcctaaaaagacattgatattaaagagtaatgatggggaaggaccaccaagtgatcatttataagatgctgcgagaattgctaaagttgagggatggattctgcattccaggagaacaaaggaggtagatcccgattaactgagtagcaggatattgagggaagcttcttgtaatgattcagctgagtcttacacaatgaatgagacttggatagatgaacatgcattaggagacatcagttctggtcagaggaaacagcaaatgcaaaggcccagagccataagagattcagatgcactaaagaaatatcccatcatttaggatggtcggcatatacacagagggcctataaggaaggagaagaaactgaggttgtagaagctggtagggactgcatgctgaaaggcattgtaaatcttagactaaaatctgtgggagactttgaacaacctaaagattttaagcagagtgatgcaatgcatttgtcttttgaatgcaaatattgctggggcgggtcttttgtgttatcagctaatgatttagttggtggttacctgagtacggggtcaggtgtatgttcttagctggtggaggccttggggatgtagaagcacaaacgggtaagtcactggaaaggtaggtgaaagattggccaatattagaggtgggtgtttatagaaatgaatgacaatgaccactgagtagttcctaagacaccatcgctttgcataaatcatgtcattgaatcctcttaagaacacacaaactcaaatattgtgtattagtttcccatggctgctgtaataaatgatcacattcttagtggcttgaaagaatatggatttagtatcttacagttctggaggtcagaagtcctaagtgggtctaactgggctaacatcacgaggtaggcagcaataagaaactaatcttttggtggctttgggtacagtccctttccttgccttttatagccactagaggcctcctgcatgccttggctcgtggccccttcttccatcttcaaagccagcattggtgagttgagtcctttttcacatcatgtcactccattcttctgcctccctcttctaggttttaaggagacttgtgactacattgggcccacagagataatccagaatagtctccctattttgaggtcagatgattagtaactttaattccacctattcccttaattccctgttgccctgtaaggtaaaatatattcacaggttccaggtatcatgacatgcacatctttaagaggctgctattctgcagatcacatatcatcatctccactcttctgagtgtagcagcaagcagtcttttaggttaatgtgctacagctatagaaagttgaaaccaagatatgaaccatgatgcttttggctccaaagtcagcaggttctaaaaggtaaaccttggtccccaattaatgatcaaaggcagtgggaaaaatctaacattctgatgactttgtagatcaatgagttttgtttcacaagtctaatgcattacgttaccatattgatctttactcttcagattctgaacacacctgtgaaagcagggtttactgttcttttgacaacctgccatctctaattagctccagggccccttagtgcagtaaacaaatccgctgaatgactcagtcctctttctcttttcttattgttggatccgttaagctgtacaaatgtagtctatggtggagggaggggtgagagcagaggggaagagaaggggtgcacagttggtcactacattatcctgcttctgctccaagaataaaagcaaaacttaaaaaaagtattgattcatatggtttgttcatatgtatgggaagcatgtgatattttggtacatcccatgcatgtgcaatggtcaagttagggtatttaagatattcatcgctttgaacattgatcaattctttctgttggcaacttttcaaatcttcttttctagctattcttaaatatataatacattactgttaactattgtcaccttactgtgctgtggaacattaaaactcacttctcctatctaactgtaggtttgcacccattaaccgatttgtcttcatttcccactccacccccacacccttcccagccttagtcaccataaccctattctcttacatctatgatacccacttatgaactcctttctcctggtccatgaagtctttaaaagctatttcgtcagaagaagatttgtctgacccccttccctatgtaaatgcagcacattgtcatactctctcaacacactcttatttctctttatagaggtcaccagatttttaactcctttacaggattttctacttttttatagggtgagcggtctatatctattttattgtcactttatcctttcactcctcaactgactacatggtaggtattcaaaaaaaacatttgttgaggccgagtgtcatggctcacgcctgtaatcccaggacttttgaaggctgaggcaggcggatcacctgaggtcatgagttcgagaccagcctggccaacatggggaaaccccatctttactaaaaatataaaaattagccaggtgtggtgtcaggagcctggaatcccagctacctgggagaccgaggctgggagaattgcttgaacctgggagttggaggttgcagagagccaagattgcgccactgcactccaccctgtatgacacagtgagactctgtctcaaaaaaacaaaacaaaacaaaacaaattgttgaataaatggtcctctagtgttttaatggcttttacttttgcttctgctactggtccttattcatccatctacctccccatctatctgtccatctacccatgcatctatgtgtctgtccattcatccactcattcctccatctatctacctacctgttcacacatccacctatccatccgtcctccttgaagacatacttaagagtacctagcaatccttctggagttccacattctcctctctattttcttcagcctgaagtcccaactggtacatgggcttggtgtgagggaactaataaatgcttatcatgagaataataaaagctaagatttatttattgagtgctagtcacatggcagccaagctctaaatgcttcacatgcattaagttagtaagtgtaggaagccctctgcagtaggcatttgtaatatccccaccctgaggatggtgaaactgagagacagcaaccatgggaacacagggagtaaggctgggatgaatccctggcaagcgaactgttaattctatgtctcctaccttcttgttttccctagcctgctgcaagtccagcttaaaggaaggaaagttctaataaattgaaaatgttaactctgtggactagacatcttcacgtgcttcgtgttcaacatgttataacttcaccataatacaaattaccatcatgagtttatttttgtatatggtgtaaggaagaggtccagttacagtcttctgcatatggctagtcagttatcccagtaccatttattgaatagggaatcctttccccattgcttatttttgtcaactttgtcgaagatcagatggttattggtgtgtggcattatttctgggccctctgttctgttccattggtctttgtgtctgtttttgtatcagtagtgccatgctgttttggttactgtagccttgtagtatagtttgaagttgggtaacttgatggttagaatgttctatttgcttaggattgccttgactattcaggctcttttttggttctatatgaatttaaaaatagtgttttttaattcctatggtgggaagaaagtgtggataaaaaactgcctatcagatgctatgtttatcacctgggtgacagaataatctatacaccaaaaccatgtgagatgcaatttacctgtatgacaaacctgcacatgtaccactgaccctaaaataaaagtttaaaaatattacccttttgtttgcttcattttgcaagaaaactggttggctatccccaaaaagatgcaattactgtcatcttcactgagtggtctgtaggtaaacaagcatctggagatgagtttaagtcctcatggtttaggattttaatatatactaattaaaacgagcaacatgttattattcaataaagaatagaagcaattgattttaaatcatagccaggtgcagtggctcgcacctgtaggcacatctacttggaaggttgaggtgggaagatctgttgagaccaagaattcaaggtcagcctaggtatagtgagacgccatctcttaaaaaattaataataataaaatcatagtatataatcatgcttagagtaaagatctggaaggatactcaatatactaggatttccaggttagaggggcaatgggggttaaggatagtgatcacatgcaactttaatcttgtctacaatttttctaacaaaaggtatttatgtattgtgtaattaagggcatgggacggtctgtgaattctgtaatcttttccttttcttttcttgcagcacagtctcactctgtcacccaggctagagtgcagtggctcaagtgtagctccctgcagccttaacctcctaggctcaagcgatcctttctcctcagcctcctaaatagctgggaccacaggtgcattccagcatgccccactcatttttttttttgtaaagatgggggtctcactgtgttgcccaggctgatctcaaactcctaggctcaagcaattctccctcctccgcctcccaaagttctgagattacagactggagcccctgtgccctgcctgtatattgtttgagaagtcatattcttcctcttctgcccgcccctgctggctttcgcaaaagagaaatcatgccgcttttttaggtaatctgtgttctgtggagggtttctaatttacttttaaagttagtggtcctcgacatgacttgtcccagttttgccattgaaaagaccccaaatgtgcatgagaaacctactgtgaaatagatttccagttttgacctgagctttgtcccaaggactcatctgtgtcagaggaggagatcctcccaaaatgtgctttccatggatgaggaagaccagccatttccctttgacggcctccttgcattttatcattccctgagccaccgttccaaaggaagagagaccattggggaaatgattttgagaagaggtctatcaactattccatttcttttgaaccccaggtggcacttctcagcaacaaggaggcatttaggcaaagagggaacagtttctatgtaaaacctaaaacgcttggactcacagagaaaggcagaattaatcactctctaaagtcaccaagagagaaactgacatgctcactagacattagaataccaacagtagcaagcattccactggaagcttgaaaggagttattttaggagaaataaaagaaagggctagttttgaagcaggtaggtcatagataagagctctggaattcagctccttctagtttttattccaagttctccagtgctgggagtttaagatcacaggcattgcatcttatcctatgactcagtttcctcatctgcacattggaaataatgacagtatcaacctcatagtgttgttgtgaggattaaattaaattatacctataggaggggctggccatggtggctcacgcctgtaatcccaacaccttgggaggctgaggcggatcacctgaggtcataagtttgagaccagcctggccaacatgatgaaaccctgtctctactaaaaatgcaaaagttactaagggatggtggtgcatgcctgtagtcccagctactcgagaggctgaggcaggagaatcgctggaacccgggaggcaaagtttgcagtgacttgagatggcaccactgcactccagcctgggcaacagagtgatactccatctcaagaaaaacaaaacaaataaaatgaaacacacatgaaacccagtggattccttagcacctaataagtatgggcccatacatatatcatcatcctcagcattactggaggttattaacagaaattggtgttaataaagtttaaataaacaggtggatttggaattcctttccaagtaaaacatttaaagtaactttgagggtgaatatacaaataagtgaagtcaagatgctaaatccttcatgggtttgtaagtgaccaggggatatttaggacatctcccttatttctaagagtaggagctcatgaaactccaacacctcactctttttacggcctgtgtctgtgcactttctgtggagctgattggacccttgggggatggccttgcaggtcagacagtcccagcatcttcttttcactctttctctttcagtttctgggttttcacagccaagggaaaggtaggcagaactggaagcaagtggaaatgctcggtctgccattcatctaggaaggcagacgcctctaacaagtttgaacctgataaagcctctgcctgtgcaaagaacttgggaagcagccagcaccgtgcttttttacctctgattagttcttcttccattctctcttctgcgatggaaagaaaaagaaaaaaaaaaaaagacatggagttgagacagcagagaaagtccaaaactgggtaattcagaggggcaggctaatgacccacctgagtctgggatcgttaccaacagtgcctggttttcactgtgacaaatatgaaggtaggcccacagttagtgagagagttgccttgtctatctcctggcgtgccttcccacaggctcccagtggagtctggtcatcagtcttctccctttggagcttgggcccagatctcagccacccaggccacgatggggaagagcctggcctgccccaaaggtggccctttcagagtttaagacgatggagatacaatggaagtctcatcatgtgtcactttgcctttgactccgtgttgccatggaaacagaacatggcttgttcatggtaaacgaccttgtcattgatttttgtatatgctcttaattattgtggcatagttatttataacctgatggggaaggaaatcccaggagaagagcattgtcctgctgaattattccatagtgggaaggagaaaagttctgtcccaaagaaaagaggagaaaaggaaaggaaacgaagatgaaattttcaaatataaataagtccttcaggaaaatcgttccccagatgcattattgcattatttaggaccatgtgcaccccactatgtttgctctcgacatttattttggggggttttgtgtagccgtgacagcatttcctcacatctctttaggactgctgatgccctgcatatcccctgtagaactttgcggatagttcatattttagcaatgattttggaattcctggctgaaataagaggctttgtgaattctctactcctatgatggcctttgaggaaattctggatctttggtttggaagttttgggattctgtgaaccaacactttcttttcattgggtttgatacagtggcatcaatcttacagtttatcatgtaccgatgtttaaaactctaaccattggttatctggttaccatcattgtcactacgaaataaaggattagagctataaaaatactaaaatagataatacccttgattatctaccctgtgtcaaatacatgaacccaactgctcaaactgtcattcattggccaggtcatcagcctccgctgggaaggagttggcactgccaagtcccagacccttcctcagacctactgaaccacctgttgcattttaatgacggctcacccctctgcactcctggtatggtttggctgtgtcccacccaaatcttatcttgaattgtagctcccataattcccatgtgttgtgtgagggacttcgtgggagataactgaatcatgggggtggtttcccccatactgttgtcatggtggtgagtaagtcttactagatctgatggtttgataaggggaaatcgctttcacttcgttcttatattctttcctgtctgctgccttgtaagacgtgactttcgctttctgccatgattgtgaggcctccgtagccatgtggaactgtgagtccattaaacttctttttgtttataaattactcagtctcatgtatgtctttatcagcagcataaaaacagactaacataacccccctttcttcctacccctgtgatttgggtggatattaaaattttgcaagccgccactctagagaagtaccactcaaaccatggtctgcagactaccagcattagcaaggcctgggagtttgtgagagatgcagattcttggtgcccatccaaacctacagaagcagaatctctggtggcaggaaccagcaatctgtgctttcaacaagctctctgagtgcttcttctgaatgttaaagtataagaacctctgctgcacagggagacctcactttcattattctcatttcacagatgagaaaaatgagtcagtaggaggaaaagtgattgactcaagtgcttaataagtgtctaagctaggatttgaccctagggcttgtgaatctggagcccatagactcaactcctgtgctatactgcctctgtgtctttggtctgtgttctcttctttttttttttttcttaccaccctccaaaattcttatttatttattttctatcaccgtacttactggtggagtggaagtcccttggaagtgggggacgtgtctgatttgtgcatggctattttgcgatttgccattgctggaatatttagcaagcatcaatgagtcctggagggcttttaaaccatagatgatcagggcccctgcttggtctaggatggagcctgcaattttgcatttgtgacaagctcccacggatgctggtgctcacttggcatagcaaggggttatgctatttttcaaaggcaagagaagtgtgcatgtacttgagaggagaaggggtcggtcaccatttactttgtgcctcttgctacccttcgttgcctggagttctacacactttgcaaactttacctcattaatcttccccaccctgggagggcctgtgtgacaggcactggtacctttatttcacagatggagaggcagcagtgccaaggggctgtgacaggcccaaggtcacctggcaagtcccttgcatggacccagaatagaaacgccaccgcctgccacaaacccctctcctctggctcctgtgaacctttgagcccccaagcctgttaagcctcttcctgtcctctctatcaatgcccacttgcactgcctcctaaattagctttgtgtctttaaccccagcctcgggaggcccaggttcaaggttagcactaagcaccttttgagttccttgtaagttggacgctggaataattctaagtcaagagcaattaattatagaagcattagtcctgcagaaaccctgcttcagtcttttgtttctggctgctgccaagggccatgcacattctctgtattatctttctctgcatgccttcagagtttatacattcatttccaccaaaaagctcatcatctgagacccttactacgggtacagatgtccagacaccacatccagctaaaaatccagaatcaatcactgttttactaacaagttcctcaggggactctgagacacacccatcccggaaaattcctaagtggagccaggtgcatcagtttccaggagcactaagtgtccaaccctgattggctggtaaataattgggagggatgtggcttgggttgagggatgtggcttcgttgaaggacggcctggactgcacttcgtaagccaccttctgtagttctgatactattaattcatgattcatatcaacagaggatgggctgggtagtcgagttcctggttctttattaggcagagaatgtttctccatctggttgagagtctgtcatgttgtatgagtccagggggcgacacattttagaatttgaaaataggtcgaacccgatttgctttctttattaggcagcactcacctgggggaatggataactccatttggttcagtcaaaatgaaaattggccaaagaaagtgttaagagggcctgccatttgtgtgagttgagccataaacattggcctgctttttagcttgtggttcattggtgtatagatgatttcatgatgacgtcagtaaagggtctatgagaacacaaactacaccgaaattgacatctgatagggtcctgttgtctatgtagccacaggaggttagttctgagtgtcttcatggttaaagaagaattcagtcaattgattatgtgattctatttttataaaatatccagaggaattaaatccatagaggcagaatgctgattgctgattgccagggtctgaggggatggggaagtgagagcaattgcctaatggttgtggggttttcttttggtgtgatgaaaatattttggaacttgatagaggtagtggctgtacaacaagctgtcactgaagtattcactttagcatagtacattttgtgactgtcacttcacaaacagagtcacaaacaaaattcatgactgtccttgattttgagaggagactgtatacaggaaagtgctctgtgacttttacgaaataagacaaataaaataaaccctaacccaactccgggcatccttcccttttctcaaagacctcaccctaatttaagagaacatgaataacaaatattttacttccatattaaaggagttcttttctctgtatgtcatttatcatagcaaacaataaaatgggtatgaatcatcatctttacaagaaggtggtgtaacagcctcattctgaatccaggagccatctctagataaaacaagatgcatggaagatgtgacttaggaatgttgagcacatattattctttttataaaatagcagagttgaatgttggggatgctctaaagtagtcaacttcagcttaattgaaatgtgatgcaggcttattgcattattgttttttttgttgttgtttttttttgttgttgttgttttttgagacggagtcttgctctgtcacccaggctggagtgcagtggcccgatctcggctcactgcaagctccgccttctgggttcacgccattctcctgcctcagcctcccgaggagctgggactacaggcgcccgccattacgcctggctaatgttttgtatttttagtagagacggggtttcaccatgttagccaggatggtctcgatttcctgaccgcgtgatccgcccgccgcggcctcccaaagtgctgggattacaggcatgagccaccgcgcccggccggcttattgctttattctaatgtgatgctttggtagacctgagcttcctccacacactaaacacaaaccttgcacttaatagactttgattgaaggtgcattcaaagttcaagatgatcagtttggattctctttttttgtcacataataacgaatatttattgagttgctatagtagggtccatactttccatacattgatctatctaacattacagcaacaccttaatatagagactattattgtttctgtgttttaaaagaagaatcccggtccatcaatcttaattaacttgcccaggttaacagtgtttgtcaaaatagcaaagttgggatttgaaccctgggtggcctgaacaccaaagcctgtactgttaccatcaccctcttataggaatgttccttaagtgttcttatgtgtaagaagagtctgagatgaagagtttcagagggatgactgtgtggccaatcttccctacaggcacaaagggatttttttccgtctcgaaattgtcagcctcctattctaaaggtacaggttcctcctatagagttttagggtcagatgtcagttttaccccaagtccaccactagctagcagtttgacctttgccaagctccaaaaaccatctgtgtccattttcttcctctgtaaaatgggtataatactgacttctgagaaaggctgttacaagctttcaaagaaatggtatttatgagaacatctaaaggctggagtctccggacccactctctcactttccccttctctgtcctcaaaacagcatgcaccttcagtgggtgtaggcctctgggtctccatcctttccccaccaaataatcacatgcagacagttgtaaaaaccacagagcattttcctgtacacgatgtcctcatactgaaccaagtcgttagcatccatgtgtggctttattttttctcacaaggcagcctggaaagaacaaatttatttgggtgtgatggttttgtatcttctactttttaaattattattattattttattatttttatttttttgagacagagtttcgctcttgttgcctaggctggagtgcaatgatgtgatcttggcacactgcaacctccacctcccaggttcaagtgatactcctgcctcaccctccggagtagctgggattacaggcactggccaccaggcccagcgtggctcatacctgtaatcccagcaatttgggaagctgaggtgggtggatcacctgaggtcaggaatttgagaccagcctggccaacgtggtgaaacctgtctgtactaaaaatataaattatttttattgtcctggaacactcctacccctgcccaaatcctgcacatatccacagctgcccttgccctcatctgccggggcagctgtagtgggaatctgtggggccagattgtccgttcctgggaggtgattatttggccagtccacgaatagtgcactgcagtaggcctggctctcggaggcccagggtgggagctgattgctttggcttgatcacatttcttgagagtttcacattctaataattaaaacccaaaatggtgtgactgttgcattggctgcattttgtttcctatgtgtgtagcagggtggtctgatttccttccttataattcaagtattctgaacagcagtatgagtttcggcctgaaggaatttattagggtaatcttccctctttcagccaaaaaaaaaaaaaaaaaatgcacccagaaatgcatttagtggaaacctctagtgacaagcaatattctttcttcctttctcctttcttccctctcactatctttccttcttagaaagaatgttgtgacatcattaggtctgtagtaagagtttgttaatttttctaagaaattatctttaacactgtataaacccagtttttatttcatatgatcagatttaagttggtgcttcagtctctaagtcttacaacggtgtcatttgcaacaacatcaatcattgaattgcacgtcaacggctgaggacatctttctctgcacaggaaaagtttcctttcaggcaggttgatctggatgttagtttcaggataattctctctctctctccaccctcccaccccttccagcagctcacgccacgtcttccctctccctctccttttatctacctctcatttttatgtaaagcattgtctttcagataatattgttcccttgtgaattttatagaacggttattgaatcattttcgcctcgatttccaagtgtgttacctttaccttgacttggtgaatcacagctgttaaactgtgtctcgtgattttcattttagagtaggtcctggtttttattatagaatatgctcatcttttctaagccttgtgtcctggcttgtaggacagggttggggttggaagtaacttggggtcatttggggttttttttagaagaaagtgatggagtctgggaatttctctgcaggcttcttagagtgttcagggccattctaatgctttcccttggttcagtcttgcaagactttcataattgtgagcaaccacagtgtcttcccctcttttggacaattaagggatttaaaatatagatcgaagttggacacttgttggtgatttaggagatgaacagtagcactgtgtgtcagatatctgagaacatgcaatatttgctcagtgggtagtgggataagccagttccatccaagtcatgcagcctaagaatgaagaggaggcttggggtctgaaccctgtgggtttaattctgtctctgacagttaccagttttgtgactgtgagctattactttcattctgcagtactcatatgacaaaagatgggagaagtgataatggtattcccttcataagtatttttgtgaaagttaaattagatgacatatgtaagatatctaacatatgtctgatgtatcacggtcacacaataatattataacttattaaatttattattactgttgttgtcagtcaggctaggttgatgctgtaacaaacatcccccaacttttcaggtacttaacagcatcaaagttgatgccttattcatacaaagccatgaacaagttttctagatcaagtgataacaagcagattcaggctccttccatcttgtgactctgctgtttcctggcttcagtcacccttgaatcatccaaccaagagacagaagcaagagccactgagctaaggatctgggggtgggaaatgtggaggtcaagtctggagtggacattcctcacttccacctgcatgccattggccagaaccagtcatgtgacctccatttcaccacagagtagcatgggaaagagtctccctggggccctagaaagatgaaacaggattggtgaggtccacccgccacagggttactttttggtacctgaaattccccttttttgctctgttccaatttggaagaaacttttcttttgactctgggctattacttcgccctagccattggggctcagcctctgtggtctcagcttattgtcctcttcctctgttcccagttcttgccttgaccctagagaatttcaacactctggtcctcagcctagcaggattgtccactctatcctgaatagcaacagtcatagccttctaattagggacatcataggtttctcccagttgaaacacacacacacacacacacacacacaatattatttttaattgacagacaataattgtatatgtttgtaggatacaatgtgatgttttgctatctgtatgcaatgggcagtgattaatggttccatttaaaatacgcttcttaagtataaggagaatatccttcatcagtactctttatattgcaatattaagggaaacctttagaacttaaagaataaataccttcttccaagagtcaagtgacactatcttggaaataaggtaatattcaaagtaggtttttaaaatggttttatagaggtataatttatataacataaaatccacctttttcaattttacaattcaattatctttagaaaatttacagtctaattttagaacactgtcctctccttaaagagagctcgcctccaagcccatcttgcagtcaatctctgttcccaccctcagccccaggcaaccactaatctatcgtgttcctagcagcataattcaaaatagcccagaagtgtaagcagtcaaaatgtccatcaactggtgagtcaacaaaacttgctatattcaaatactgtaatacactttagccaaaacaaacaaagagataaaacaaaaaaacagaatacaaatagaagctacaccacatagatgaacctcggaaaacattatgcacatattatgcaaagtgaaggaagtgagctgcaaaagactacttattatgagattcctgtttatgaaatgtccagaaaaggcaaacctaacgttgattttgattgcaattttccattaggcaaatacctagaactttcttttctaggagcctgaactactcacatgccttgggcctttggggctaattctctttaacataagaatggctaatttgttgcttcttagatttgctttgtcattttgtctaccaagggaagaaattcagaagccaagaaggagatggtgactttgccagagccatattaaaaaggaaaccatcttacagctcatcattcctctctcacctgaatcttgtttgatttctcaaagcccatgtgggaccaccctccatttttaagttactgttttggagaatatgtacagtgtctactggcacctggtggcaggcaggaatgtttaagctgatcatttgttttaaacgtaatccatttgtaacgcatgattcatctattgctagaaggtacttggcatcctttgcatataccgtgactcaaactgtgacaatgtttatagctcagaaggtaaaaaaaaaaatcagagttttgttcatcagaattatcacaaattccacatttttggaattgaagataatgccatcttagcctatttaagactggcattctagaaagaggcatgctgatgcaagcaaagcaaagacaatcccaaaaattaacctgttttagaaatgagcagccaaatgtctcctaaacttctatggttattttcatggacactaccttttattttattttatttttttgtttttctgcttataaaatactatgtactaattgagaaaaacttggaaagtagaaaaaaaatatatatatatatataaattaattcccttgtcattcctgtgtctagaatagttaataacatcattctgatggatttaccttttatttatgttttcctgtatgtatgtgagaactcaggcacttaattgggcttaagctgtatatgttccataccctgctattgttgcttgacattttattatggatattttcctccatgtcattaaatattcttcaaaaagataaacttaatggtcatagtaacccaacatttttggatacaccatcccacttgccaccccccagctctttacactaatattgctttagtcttttttttttccatcctagttaaaagctgagatgaaaatttgtaagtagagatggctgagcacttctccattttccttcaatggctcttaaaagtaaaataattggctccaggtatagacaatattaaggattgaaattgtctgtattgacttctttatcaagaatcaggtagttttggccgggcccagtagctcctgcctgtaattccagcactttgggaggtctaggcaggctgaatcacctgaggtcaggcattccagactaccctggccaacatggcaaaaccccatctctagtaaaaatacaaaaaaaattagtcaggcttgatgacaggtgtctgtaatatcagctactccactagggaggctgaggcaggagaattgcttgacccctggagtgggaggttgtagtaagccaagatcgtgccactgtactccagcctgggcaaaaagagtgagtatctgtctcaaaaataaaaaaaaaaaaaggtagttccatgctcttataaataaagaatagtactgcgttagcacataaaaatgggttgaccttcaatgagacggtcatggactttcgttcagaaagactttaggaaagtctcttcattgccaaggggtatggtccatctcttatggaagtatgcatatcataaggaattaaaatgactctccttcttttcctttttttgagacggagtgtcgctctgttgcccagggtggagtgcagtggcctgatctcagctcactgcaagctctgcctcccgggttcatgccatccttctgcctcagcctcccaagtagctgggaccacagatgcccatcaccatgcctggctaatttttttttcggatttctagtagagacggggtttcactgtgttagccaggatggtctcaatctcctgacctcgtgatctgccctccttggcctcccaaagggctgggattacaggcgtgagccaccatgcctggccacccctccttcttttaaaaaattcctgcagtcactctgaagaatgccatttagaacattcgagtgaaccaaacataatcagcagcccagagaagacctcttttacctgcctcctcttatgttgctgctgagatgaacacagtccttggaaagtggtggttgtgcctttgcttttttgtttttttgtttttttagttatgggccttgccattggtttcttctgggtccccatctgtggcctctttgcttatcatggcctggtgaccccctagtacctgatgatatctatagtaggtctgctaggaaaggcttggagtcttcctttcactacccatgaaatgaccctccaggcaagtcactttcctaacacagcattaataggtgttgcttctttgagataacctctttcttatccacatgctcagggtacatatctttgtgtttttgtttagtaagacacactcctctgaagctaaacttaatctgcggagatgtcggatgataaatttgtcccctactgtagtgtcataatatatcctctatgtattaattaaaatgaagttagatattgcttttcagacaacattagttcaagatgctttcagtacaggattaatacatgtatggatgcacggatggatggatacatagatgaatgggtgaatgaattggtggacggatgaaaggatgactagatgcatgggtggatggataggtgggtgggtgggtgagtggatggatggatggatttgtgggtgggtgggtgggtggatggatggatgggtgtttggatgggtgggtggatggatggatgggtggatgaatagcaatttctagatcttactgtctataccttactttgagcactgagaaggaaataattaatagttgattctattaatttatgcttccaccagtttcctggaaattgaatttcagagttttagccatgtttcctccaaaaaaatcattgcctttcttgccttatcaattaagattagtcttgaaaaaaatcccacctgtgatgtcacacacagctaccttttgctgttaattctggtgaaaatattaggctcactattaatatcaatacttaatggatcataagaatcaaatatcaaatgaagagaccaacatacatgtattacttcttaaaaaaatctttaatgactaggaatgtattttaatattggtgatacctaaatttaatgcaatatacatgtctctgttgttttttagacccaagctttttctccttgagataaagaatgatgctcagggtagtgtagcagagtggttatagaagagggccccggaatcagctttctgagttctgacagctctgtcatttggtactcgtgtgacaatggatctctgtttcctattctgtgaaatagagatactaacacttgtaaggtggttgtgatatgagggtgaaagaatgcaacatagctatgtgtttaatggagtgcctgtcacacagtaaatgctgctacagggtaggtggtgctgtgctattatgtggcattatcatcatttcctttattattaaatagcagaagttgggatggattaggaagcagacactcagaaaatatggtgagcttataaatgttctttggtgcaataaattgtcacacagttggtggcttagcacgacatttattctttcacagttctagatgacagaactctgaagtcacatagaggtgctactgggcctatctccttctcaaggtcctgggggagtgtctcctccttcctcttctagcttctggtgggtgctgcccttgactggcttgtggccacatccctgactccttccaatctatgtccccatcttcacatcaccttttcctcttctgtacacgtctgatctccctctgctctctcttatagggacgcttgtgattgtattaatatttcggacccacctagataatccagaataatcaccccatctgaagatcattaattgaatctcatctacaaagacccttttctctcacaagttaacatgtacagactacagggattaggacctgatatcttcgggtggcgattattcagcttaatacagtgggttagaaataaaacttgattttccattgtacaagaatgggggtttagtcttaatggttttatcatgccatgtacataaccactgtcagtatcagtgggggcgttttctgaatcgtggcttttgttttctgtgagctcattgccccctttcccctttaatattctagtaaagcttattttacaaagaaaaatgcctgcagtgaaaagcatttcttgatcatctttggatcaatatgtaatatttatatttcactgaatcttcatgccgtgtttcaggtttagcttctgtgtcaattttgaaatgatctgtggtaaattccatattggaaagacatgggtctcctctactgacttattttcttcttattccctgaaaagcctttcttatcaccccaggaattgtggagataaattttttcactcatgaggcataatatagttagtcgatgatatatttgttgtaaaaaactctttttccattgtagtccaaacttaaatttccctagtgttcatttgctttctctattttctagtgcacttaaaaatacatttgcagtcacgattgcctgggtaagttataaatcctagatattagaatttttatgctttagaaataataaatgagggcttaccaattaaagataaaaaattacttgactggggatagtagaatattttatcagtattattaaaatttaagggcagctgaaatgccacaggaatccttgtacaacattttggtttaaaaagttggcttaaggataagttacattcttttcttcaattttacatcaaataggatattatataaatttcttaaaacagagcagaaatcttgttgaactgaatcaaatgcagagcttttctccagttgtagccctgtggttttactttttatgtttggaaatcacttttttatgtatcttgggtctctaataattaccattattactttatcaaaataatgttaataccacacatggaataaataacctcatgtgatttattgtaaaaccaaggatttaaacaattaatatatttaatccatcagcacatctactgtctatggataagtacatctattttgtggatgatcacaacaggtttttcactctaatttttggttttctgtattttcttcttcttttttttttttttttagttcattattcttttagctctctggtaccctggcttcttctttgtaggtcattgtgacttctttgcagcatcatcacaattctctatagcttgataaataacctctctggaaattgatgattgctagagaatagcacagaattctaggtaggcactgaaaaaattataaaataaaataaaagattgccttttcagaagatgatcctattaggagaagcagaattctgtatcctgcacaaacacaattgatacctaagtagtgtgcatttttaagcagtcatttgtgaaatgatgtggacttaatggcagattaaaacaactacccgctgggctgtttcaaaaaacaaaaccctccaattaagatggatccatgagaatgtgaaatcaatctgccctaacattgagcactttctgtgtgaaggacactccacgagtggcatgaaataggaacggaggagttgaatatcatctcagtcctcaagaactgtataatccagagcagtggttctcaatgggggacagttttgccccccgccagaggacactaggccatgccttgagacctatttcactgctgcaaccagggaggcagtgctgctggcattagtgggtagaggccagagacggtgctaataattctccagtgcacagcaccagcccccaccacaaagaattacctggctcaaaatgtcaatagtgttgagattgcaaaatgctagtgtggagtaaagggaaaagcatgtgcagaaaacagtatttcaaggaagtcatgataggtaccagcatatttatgagggttcagtggaaggaagagattctcatgggttatacaggggtggaatggggaggtcagacctcatgctagacttaggaagtgtgatttgccttgaaggatgggcgagagagggagatcatgagggcatttcataaagaaaaatggcaatacaagaatgatattcataattcttaatgaaaagtacgccacatacactgacttgctggaacagacgtctcatcagtcagaacagaaatgcaatgtcaccccattgttggacatacaggtctcatatcagccttgtgacaaccactctgtctcaagactcaatcagctatcttgttagaactagttttatggtgaactgggatgggcttattttcttgaagcccttcaataagaaaattggactttcctgatacacagagtgggctgtgaaaccaccaacaccttttgagttaaggagtttccaagaaagtttgtcattctacttccacccactttgtcagtgaatttcttaaaaggatattaagtgtgtgatggaatcttataggcatgtcccattggagttacagagcaaagccccaggactatggcttttgacaaatgtgtcatcaaaataaactgggtatttctaatgtgagtcattggcggtaacaggataggagaagactgtgatgatgaaggcagtatttcaaggagtttaattctggggcaaaatgcagcatgatttggaatgagaagaaaccaaggaagacttttgaaaattgtttgggtataggtagtggggtcagaaattcagacatacattagtggtatgattactaaagaatcagtaccatctaaactctctcatcttcttttaagtgatttgacaaaaaggggtaagtgtatggattgatataaataatccatatacaatacttggctcagaggataagtggttttggacttaagaaacatatgctaaaggtgtgattattaaaggatcgctaaaacttaatctgtctcattttccatttagtgatctgataaaaaaaaagtaggtgatgttatagattgaatgaagtatttcacatgaaacacttggcccagtgtaagagtggtttggaagccaataactggtatattccagaccaattagctagctggagccaattaaccattaagttcttcattgttatgaagaaggtaatacattctgtggactttaagaacttctgctataagggttataggatgaaatgcaggtaggaattgagaacagtgtctggaatcttgtcagtgttaaataaatgaatatagtaaatggtccttcaaatgtttatccgatatgtgcattctaatagagaaatcaaagtttaccttgacatgttgagtagtagtcacttgagtaataaaggttcgttaaagaagtccgaggctgggcacggtgactcacgcctgtaatcccagcactttgggaggccaagatgggcggatcacctgaggttgggagtttaagaccagcctggccaacatggagaaaccccgtctctactaaaaatacaaaagttagctgtgcatggtggtgcatgcctgtaatcccagctacctgagaggctgaggcaggataatcgtttgaacccaggagccggaggttgcggtgagctgagatcgtgccattgcactccagcctgggcaacaagagcaaaactccgtctcaaaaaaacacctggagcaagttctgaggtgagagatggagtggaatcgttttcacatgcccagagtttgatataaagaagggacatgtctgagtgaaatacttagcgggcatttggaggattttgtatctgagagatcagagtaggattgactggtttggaaatctttgtagaggggagttggaaagtgttggaaagtaatttgctacatcagcttttaagtatctcctgtttattgtttgcatttttaacttcatttgggcctagaaatggcaaggaagcaccattgaagccaagaaaaatgtatcagacagctattgccaccatggttctgtgtaacaaaccatcctaaagcatagttcctcagataactttgcttactcctgagtctgtggataagcaggcatgtgagtgctatgtggctagtccggactggattgtagactccaagatgcaagttgagttcacatctgccctggtgtctttcatcctccttagaccagagacttctttggacattttcttctcttggtgaattacagatggacaagagggtgaggccgattgcaaaagggcattttaagcttctgctcacatcacttcctctcacctctcattggccaaagcaagttatgtggccaaatccaaggttaagcatcaacatagccaccattaggctatgatactgatgtgttttttaatactacttcagggaagtaaagagccagaagaaccacagcgacataaaaggaaatttttctgggtgatgaaaagtgcaagattttgtgtggacttgttgatggtactgtggcagccatcctgtgggcatgatgagatggccaggagcatcacagagacacagctcttgaagcaaaggcagaaattgcctgtctccgcatttgttgatattgaagccgtgaagtcatgctctctgttcctcacagtgaagggcaagactaaggacaccagaggggtatgaggagggagaaaagaagaagctgaaactggaccttgggcttcacccacatttggagttatgggagtggcagaatgcctagcatgtaacatacactctagaaatgtttgttgtcttgaattgatttgaaggcgtcagacaggccgtggtctctgtgtctttttacatctgttattccactgccaggccgttctcctttgctcccatcccagagaaacctgtatcaccaccggcataataatgacatttcattattacgatctgatactctagggctggtatccagctgttctaaatagagcaggtttctgtcaaagaggtttcacttaggactaagcatgactattcaaactactgccacctggggagaaattatttaccgttcttcctagttgtcaatctctagataggtatgttctcattattttttttctcccttcatcttctctcatattcacaaagaaaaaagttttgtgttattacagaatgatctgattttagcaatgaacttcttctcttgttggttattttacagttagattcttggatgaatattatttccatcttatgcaattaagagtgatctctcatctgatttcagtgaggaaattcttctgtcgttgaccattttacggttacagtctttgaggaattttatttccatcttatgcaattaagaataatatctcatgcggcattaaattgttggactgtctttgaaattgaagacaatgagaaaattctagcatgagcatcacctttttgtgtgtacgtagctttttggatctcattacttacagtataaaaaggcaatagttgctgcagttatatttatagttgtttattcctcatttttctaatggaacttgtcaattagaatcaatggcataaaagttttcttggagggggcgtaacttatggactactaacactgcctttagttcagtctttctgatactgtttttatgagacaaacaatgatatgcttgccttgtctgttggcaccaaacccctttgaaatgtatgttagaatgtattaaggtttaggatgactaatggctagtgatgcaggacgggcaagtccaaaagttggggcttagcctgggaggattattggcttcacctgcaaaagaattcatgtgcaagcagatggtgttagacagcagtcttctattgaatgatatggctccttgcagaggagggctaactcataggcactgagcccagagttggcaacatacgggctattcacaactatatttacactgacttagaccattttcagttacatgcaaattaagggacaagttaatgcaaactgaggggtgggttatttagaactttccaggaaaggaacagtagcttccaggttgttgtcatggaaaggggtagtaacttccaggtgattgccatggcatttgtaaactatcataacactagtgtcttctgctaacgagccgtgagggtatctgggtattgcttttatcaccatttactagttcctgccattttatttttacttcatcctgtcaggacccagaaatatgtcctgccagtctcctacctaactaggattcttgtaagaaatagttggcataatgtggagtataaactttaagttttaggatttcactgccccttagaatgtaacaagtacaaattaaagggcttgcataggattgcatgctttaaatttttccagagaaaaggcaaaaagaggtctttattattatgataattttataaaataaagtgaattgaagccatatgcagtagtgaggatgtcttaacagagtagccctttaatagatttgtgcatattggctggcccaaggggtgggctatagtgagatctgtacttgtctgcataacgtctgttttttttcccctctgtccttgcatggcagccaggtggtataagattgctgagataaattccaagtatagcatatctttactctaagctagtggtcagcaaactttttctagaaagacccaggatttttgtgttgtgggccgaacagtctttcttgcaactacttattgtttatttgtgaagtttatttaccaagctacacagtgggctaggtttgccttgtggtcataattccccaatccctggtctacattacatatgataatctccagggactcaggcctctgctctcctgagctgtggtattctcctgacccacacagatttgttaaggaataggaaagtaatactatgtgcactagtgaggtataaatatctctagtacccaaaggattataaatcactctactataaagacacatgcacatgtatatttgttgtagcactgttcacaatagcagaaacttggaaccaacccaaatgcccatcagtgatagacttgataaagaaaatgtggcacatatacaccatagaatgctatgcagccataaaaaaggatgagttcatgtctttttagggacatgggtgaagctggaaaccatcattctcagcaaactaacacaggaacagaaaaccgaacaccgtatgtcctcactcataaaggggagttgaacaatgagaacacatggacacagggaggggaacatcacacaccagggcctgtcagggggtggggggcaggggaggcatagcattagaagagatccctaatgtagatgacaggttgatgggtgcagcaaaccaccatggcatgtgtatacctttctgacaaacctgcacattctgcacatgtatcccataacttaaagtataataataatttttaaaaagctgttaatcaaagttttcttattaccaagaaggctgtaggaagatactaccatgcattgcagtggagattttcttacatgaatatgataaccacaactgctgcagccacttacccacctgcttggagatgaagccagtgcaggtgaggagaggagcagagtgaagaggaacttctgaagctaaaaatatctgctagcttgtataaatgctagagtgcccagggtttcctgttatgtgcgacagcatctttcattgccgtttaatcaagtctgagttgggcttcttgttatttgcaagtacacatacctcagctgataggggagaaaacagaactcccgtgaataagatattactaggaatttagagacatgggacagcagagaagagatgagatgaaattgggagacagagggagagagaggctggtggctgtacagtaaaggtattgagaagagataagatgaaattgggagacagagggagagagatgctggaggctctacagtaaaggtattgggataatctccgttggcagatactagaagtcctttcaagagctagagtattaaacatctagttctgaatagggtgtgtgtccaagatttaaaattcctctgcaactccaaacttcattaaagtctgatgccctcaccaaagccttcttggagtagttgtagataaataaaggctgagatgctgagttccattcttgggtaagccagacccaaatgaacgggattccctgtgaaaagggtgagagttcagggggtaaagaattaaagccacaaattactatgagtgtgtaaattcctaggaatttgtggacatgtttggaagtatgctaaacgtacaaaaaaaaatatgcatgacaattacctttaaaactcagaagacagcttcaccttcgtttccaagttcattatgcatttcaaatgatcagaactaataacaattatgttcaccatacaatattagatcacctttcatggtttgaatggttccgctccaaaattctggtgttgccgatgtgataggattaagaggtgtggccattcagatgccattaggccagaatggctcctccctcataaatgagattaagcccattgtacaaagaggcttctggtagcatttggctctcttggccttctgccttttgccgtgtgaagacacagcattcctctcctctggaggatgtagctttcactcaacaactgagcctgctggcacctaggtcttgaacttcccagcctccagaactgtgagaaatacgtttctgttctttataaattgcccattctcagttattttgttatagctgcacaaaatggagtaagacgctatctaagatgagttatctttaaaatatttggaaaaaagacatagtcaagttttctttaagattttttatgtattctacttcccctaatgatctagtttccttcccaccaccatgattaaatattttcttctaaacacagtgaaagcagtaattttgttggtgataaagcgaaatatttctagtaagaacacaagatggacatctgtaacttttgaagtagcagctgtaaataatttaaaaattttttgagataattttgcactttcataagagttgcaaaagtagtccagagaatttctgtatagtcttcacccatcttctctgagtattaacattttatatcaccataatacaataatagaaactaataagttagcattaagaccatgctgttaactgaaatatatacttcattgagtttacaagattttactccagttcttttactctttttctcttccaggatccaatccattattccacattgtttttagttgccatatcaccttatgtctcagtccactcaggctcctattatgctattacaaaataccttacattgggtagattttttaaaaagaaatttatttcttatagttatggaggatggaaagtccaaaatcaaagcaccagcagattcaatgtttggtgagtgctggtttccagaatcatagatggcatcttgttgccatgtcatcacacggtgtaagggtcaaggtagctgtcttggatggcggcagtggctgctgctgccgccgcctccgcctcctccttgttctcttcctttctctttctctttctctctctccttctctccctctctttctctgtctctcttgctctcctccctccctctctccctctctttctttctctttccctctccttccttccttccttcttccttccttcctttcttccttccttccttctttgtttctccctctttctctctctctctctgtccttccttccttccttctctctttctccctctctttctccctctctttctctctctccttccttccttccttccttccctccttcctctttctctctttccccatcttcttcactaatcctgcacatgagggctcttgtcccatgacctaatcatctcccaataccatcacattagtgattaggtttcaacatgtgaatatggggagggcactaacattcagaccattttaccttagttccctccagtctgtgaatctgtgacaattcctcaggttttttttttttttgatctttcatgactttgatacgtttgatcttgcttgccatgggatcttgggtgggtcatataatatgtccgagtgtcagtttccacataggttttacagatataatggcattacctacaccatgtttcttagatggggattatataaagaaatcattttggctcaatgaatatgagctgtttataataattattgttattaattattaatattaattttagaatttttaaggggatatttctcagctcagattatctgctgtttgaccctgagtagaatgaatttatgtgttcttggaagggatgccacaaaagtgatgtgtccttagcagatcacaatggagggtcaacgatgtctttatatcttattactagtgatattagccttgatcacttagttgagaaggcatttgccaagtttcttcatggtaagattgtttttaacctttgaacttaaaagtacactaatttattactttgatggcccaatggtgattttcaatttcctctcatgccctgtacatgtattcattggaacacttgtgtaaggaagcatttttcattctcctccatttattcagtatttatatcattattgactcaacatttattttgaaggtgagctataatctaaaactgtcattatttatttttgtggctcaaatcattccacagggtatccacaggctggtttcagactcgtgaccctaagcaatcctccctcagcctcctgaaacactaggagtagaggcacaagtctccatgtctggccccattaacctttttagagtgcacatttcagtggaatttagcacattcgtaatgttatgcaaccgctacctctatccagttctaagacatttttatcaccctagaaggagaccctgtatccagtaagcagtcactcttattccttctcctctgccccagcccttagcaatcactaatctgctttctctatgtatagattttccttttctggatattttgtgtaaacagaatcatacagtatgtggctgtttgtgtccaacttcttacatttagtatagagtttttttgaagttgagccatgtggtagcacacatcagtgcttcattcccttttatggctgaataacgttccactgtatggatagactatgtatttatccgttgattagcatttgcgttgttttcattatttccttgacgtaaatagctgctatgaatatttatggagaagtatttgtttgagtacatgttttcagttcttttgggcacatacctaggagtggaattgctggatcatgcagtagctctatgttcaacttactgaggcatcagcaagctgtttcccacagcagccaccccattttacatttccatcagcaatgttggaggattccattctctttgtaaacaaatttcctatgttgtgctttcctaagggggcactggagtgaatggcatcctctccaccatcttgcttgtcatgggatcttgggtgggtcgtataatttgtctcagtctcagtttccacatgggttttataggtacactggtaatacctaccccgtgtttgttatatgaggattatataaagaaatcatcttggctcagtgaatatattagctgcttataataattattgttattaattattaatattaattttccctttccttctcaggctcttttatgttcttgcttgtggctctgaattcagatgtctgagtaaccttttagcaactcagatctgtccctgcgtttctcctctttgtaagacgtcagttctggtgctgctaacattcactgcagcccctcactctcttttttatccaaacatttctggtgtacagaacacatgcttctggatttatggtgggggctggtgaagagaagagaggagaacgaagtctggggctgttgtgtgaaacagcttgttcttcctgcagatttatttctattatttcctagagttttcacacttgatcttacatgaatgcattttgtaattttacattctactttatgatttattcatgtgtgtcctaatattacaatcaaccatatcttgataacaaatcttcctgtccaactggcctgttgggagtgtgcacctggtgtgtcctgtatgtccaggcacagccctgccaacccatcaaaatacatgcactgcaggtttatgggaacttcagtgtgtacaagacacgcctgaagagctggtcaaaacatgagactctagactctgctttgagacacagacttaatgtgtctgtgagggcctcaggagtctgtattctttacaaggtgccccagtgggtgtgatacaagctggcctgtctacatggtgggccacctgtagtgtgctgagtgtgctgtggaccacctttggagaaacaccagggaaagtgatgatgcttgaaatccttgatcctacctgcttctcttcatctcaggccactgcccgtacccagtacccccaaattctagcctccaggaatgatccagccacattaacctttttgtttttgctgtgtctgactgtgtcactccatttgcttgtacactgtgcctgccttgtctaagggagcattcctgctcatccttctgaggctcaactcagtggggacatctgttcctctgggagcttagtgtagcatggtggttaacaggtggggagctcttaaggtcaagggtgtcagggctagtctgctttctacatttaccagctgggtgaaggtgaacaagttcattgatctctctcagactgtttcctcctctgtaaaagaaggaataactaatggtacctatctttaaaggatgactgtgggattaagtgaggcaatacctgtaaaatgcctaagacagagttagtagtcaatgactctttttgttattttattttatttttgagacagagtctcattcactgtctcacccaggctggagtgcagtggcatgatctctgctcactgcaacccctgcctccggggttcaagcaattctcctgcctcagcctcctgcgtagctgggactacaggcatgcaccaccatgtccagctaattttagtgtttttagtagagatggggtttcaccgtgttggcaaggctggtctcgaactcctggcctcagatgatccgcccaccttggtcttctaaagtgctgggattacaggcgtgagccactgtgcctggccctttttgttattttttaatgtttttattttcttttaattaacgtcctgattgtctcatctgctagtctgtgagcctcttgacagtggggaacagtcctcaataatttgtgtatttctgttatttataacagaaccttgtgtctaaaagataaacacacacacacacacacacacacacacacacacacacatttttaaaggagctttcaacctgctgggaattcttgaatgaacaaatgcactttatgaattccctaatccttttctttgctattttcaccactttctcattcgagttaatctctgaagacataataccctgccatggagcctcatccctgcatgggctatttgtcacatccaggcttatattgtgctgactaggccttccgtgtgacacccgctccccattaatgattgactgacagtgggtggccaatgtgctgagtcagcaccctggggctcactggctcttcccttattgaaggggaaaggagtaactttatcttttcagttaatgggaaaaaaaagccacgggacctttgtcatccattctgctgggttgcggaatatgatctgtgtggctatgtgtgtgtatgtgtgtgtgtgtgtgtgtgtgtgtgtgtataaaatatactctctgattaaagcaccaaagttactgccaataagcttcaggataagtagaaaagatattagtttaaaagactgaaataccaccagtagaaaaataaaacaatttttcagcaaaccataaaaaaaaaaactattggaaatatgtaaactgctgttctctggagaatattagcattttaacacacatggctatcagaagaaaatctttgcataacttagggaggtacttaggaacattgcaaaattttaggagatccctcaaaaggctacacctaaaattgccttatgatgcagcatttccattcctatgaatacacacaaaggaactgaaaatagaatcttgcacagatacttgtataccagtgtttattgtagaattatttgcaatagccaaaaggtggaaacaacccaaatgtccatccatggatgaatgaataaataagatgtggtacatatatacagtggaaaatcatttgtccattataacataataaaattctgacatgtgctataatatggatgaaccttgcaaacattatgctaagtgaaagaaaccagatataaagggacaaatactatatggttctacttctagggatactaaagtagtcaaatacttagaaactgaaagtagaatagaggttaccaggggctgaaatgtgaggaataaggagttattgtttagtgaattcagagtctcagtatgggaagatgataaaattatggaaaagggtagcagcgatggttgtataacattgtgaatgtactcaatgccactgaactattcacttaaaaatagttaaaagtaatttcagcactttgggaggctgaggtgggtggatcatttcagctcagaagtccaagaccagcctgggcaacatggcaaaatcccgtctttacaaaatatacaaaaattagcccggcatgttggcacatgcctgtaatcccagctcctcaggaggctgaggtccagggatgtcttgaccctgggaagtggaggttgcagtgagctgagaatgtaccactgcctgggcaacagagcgagactccctcaaaaaaagaatagctaaaaggtaaattttatgttaggcatattatatcacaagaaaaaaatacaaggagaaaagcatataccgcttaaaaaaatgaagtcttgcttggccacaaaggttcattcccttcatggggggctcattggtttctagctgccctcgagtgtgagacataggctggagactggtaactcgtgggctggaactcacccttctgggtgttttgtttgcaccacacagtttgtattatttgtcagcatttcactaagaggtatttggcatcaaaaactgaaactggattcccttttatgttggatggtttgtccatgctgggtccacattctcctttgctacccagctccctctaaagagagtcttcagtctccatgggcacctgggccctacagaagcttgcagttatagccccagcgtgaaagttttcactctgtctcagagctgaccctctgctattggagtcattgcctttgtattgtaggatttgattattgtaatgtaaatgagcctaagatgacccctagggattgacccctgggttatttcttcactccagactgggacctggtagctggaaagcccattgttgcctaactcaattttttcttttttttgagacagtctccctctgttgcccagactggggtgcagtggcataatctcggctcatttaaacctccacctcccaggttcaagcaatcctcccacttcagccttccgagtagtgaggattacaggcatgcaccagcatgcccggctagttgttgttgttgttttttgtttgtttgtttgtattttcagtagagacggggtttcaccatgttggccaggctggtctcaaactcctgacctcaagtgatctgcccgccttggccttccaaaatggtaggattacaggcatgagtcaccgtgcctggcgccaattcaattttttaatacatccaattattttttaaaaatagcccaaacaagcagatttttaaccatctacaaccagcctgctttccatatttcacagtgcctcaccagccttaccatttggtgaaataggtctttgtagttacaaggctccaagttgagccaacgctttggaagcctccaacccagagactccccaaggggctgctgaatgacatcacctagacaagtgatcccctcctcagagttccccatcctccacatccactgctggatgatgacttgctcacacaagcctctggatggtctcatactgtaagggacattgtgcagctccctgtgcatgtgttacctcctcttacagtcatatctttgtcaagcccccaaatccttaagttccctacaattattacaatgtttttttcttatatgaaattataaataataagtcactagatggaggaggatagagatggaggagaagaagaggtgggtctacttaagagggcctttttctcccctgttgagataggaaaagcaatagaataggtgttgggaatgctcttgtttgccagggccaggagagagcatcttgtttgtctgctttgggtacatggctaggccttccaagagtcagcctcatacacatttgctctttgatgttttacaaggggccctaaactgaggataacccttggagagttaaacaatgtgaatgccatatgcctggagtgcacttctcattggtcaaggattaaattcatgggaatcgtgtacccaaagcagatgcagcctcattgtaggttctgaatccagggtgaaaaggccttgggagctgactgcagtcagcagaaatgcgtgtctaacctggattgatggttctggttgatcaggatttgcaggaaatagagtaatgcaattaccatccttggctcgctctctgtgggatgttctcacagatcagtggcaaagggttggtaggctattttcctcccattgtattgtgagatgtacaaaccttcctactgatactgccggggagagattttctgaaggattatgaggctgctatttaaaaaagtgatttccagttaaatacctttcagtattaaaatggtaaagctataaggaatggggggatagtcttccataataattgcttctcaaggagcttagtctgattgtcttattaacaactttaacttcatccttttcctatgacaaatgagaaaagaattctgtgattcattgaacagtcagatttccaatatggtgtttacttgcattttcgtttccacttcagccaggaaatcaaatccgagggattaaataccccatttgaaatgtaatggagaattacaccaaaaaaggaaaattcacccacaaactagagcaacttcattcaaaatttcagatagtcaagagcgccagcgcatcgaggaacagtgacctaaccttcgcaggccgttggtgttagccctctcttaccttcctactggtgccatgaaattcactttctggcagtcatcatagctaatagtggccatgcattgaatgcgcactatgtgccaagtctggtgattcttatttttttttaatttaaattttacaactctgtgaagtagatacttccagtgtcccattttagaagaaggaatcagacaaagatagttatgtaatatgccgaagatcacagacatagtacatggtaaagtcaagttccaaactatcttccatatggctttagactgtaatccaagtcagcatttatgtgcatgctaccaggtcaggtatgatgggatgcctctttttacttaatatgtatattctgggggtctggctcctcccctggttttcactagagcaggttttgttctttttttacaccagaactctctaaaacccaaaggcataacattcacataatagtcaacatgtatgtatctcaagggtctactagagaccaggtaatgagctaggagctggaggaaggaaaagacattaaaaacaatggtcctgccttcatgaggcttacactctcctgagaagccagcttacaaagaagcaaacagctcagaaacaggttatgccttatgccaggtactaggaaaaaaatcaatgtggttgtgagataaaaaacaaggagggtttcatcgatataggatggtcggggaaggctctctgaaaagacggtgtttccactaaggcttagagagggggaaggaatcaagctggacccacatccatgggaagaacatctcagaggtagcagcaagtgcataggcctcaggttaggaacaaatgtgacctgttggagaaactggaaggatgtcaacatgggttgaatggagtaagagggtaatgaggaggactgccctagatggagtcaaaggtttgggtttaaacagcagaacaaacctattccatatctcagattattttgtctctctctttttttaaaaaaaaaaaaaattgttttccagtattgtttttctcctgtttcaccttattcaagcacctgctctagttcccattatttttttttaaaaattgctctctgttcatgtggaccttttaattcaagaaatgtttgagcattatatgccaagccctgacgtaggcaaggcagggatttgaaagatgtgaagtgatgtgtctgtgggccttagaaacacgtagctttgaattccgaaagtgagaattaagttgaccttgcagaaatgaattgcaggttaggtggtggtaagtctctaaagaagattcatgtgggaccttttcaaataattctgttctccagtcaattttaaaccaccctgcgtcccagcaaggacagtttatggctttgttcacatcatagatttagaaatcaagacctaagaaaggtcacaccattaaataaatgttcaacactccgggaaaaatgggatgttaataacaaattctcagttgagtgacattgacttgctacttttgtaacagctactttggtttgcatttgtaaaacctaaaaaaaatttttttctttacttttgttggagaaaagggaagtttttgacctgagcattttctcacttcagagaattgaataagggaagcgtgcattgattaatattcttgggggtgctagaaatgtatctgaaaacctctccagtctagtgtttctcaaattttaatgtgcttaaagatatctggagctgtgctgtgaagtcactaggcacatgtgacttctcagtacttctgaatacttgaaatgtagctagatgaaattgaggcatatctctaaaatgcacacatttgaagagttactatgaaaataaatgtaaaatatcttgacaatttttgtatcaattattcaatagaataaacttttgatatattgggttaaattcaatatattatttaatcaatttcatttatttgttttcactttttaaataaaatgcagctattagaaaatttaaaatcgtatatatcttacattatgtttttattttaccctattactctaagaagacttctgtgtccagccatgatgctacaactgataccaggttggtcctcagactgaaagcaatgaaatacctaaggctactctttttaagcattgatcaaaaggcagctctgtgatcttggagagaagggagacacctaaggtgagcctcatgaaagctctggctttctgtccaggagcccttttctgctgcaaggcaggtagttggtgccaagcactgtgacgttctcactgagctgaagatttgaagagtagagttctgggattctgaagtggaatcgttttggggtcaggtgccacaaaagaggaatatgtgcagggggaatgctcataagtctgcatggaattttacagctggtccttggctgactatccatgtccagggtgacagacttcaccggagatcagagatcagttgatgcagtgctctgagctagatggtaaaacaagaatctgtgcagtgctggggcacttgggatccaagcaacccagagttgggagaccttatgcaacaccttgtgcaatcaagtggaaaccccagaatgcccatgctgaggactaagttccagtttcactagaataagaccatgcctgttgactaagttcaagatggaaacagacccacctgacaaaggataaaacctagcacaacaggatcaaatgacactctagtcatttaaccacttgcatgaacaaaattcagcacctttcagaagaaaacattattagcacaatctggatttctataatgcattatgcatcttgttcaacataccacaaaatttattaaacatatgaataaacaggatcatgtgacctatagcaagatacaaaataaagcaaacagaaacagaccctgatgtgtcatggatattagaataatcagaaatgactttaaaaccacaattgtaaatatgttgaagacttaaagagaagattgtgttacttaaatgaataaacaagggatcccaggaaaaaaaatggaagtcataaaaaggaatcaaatggaaagtttagaaaggaaatgtaaaatatttgaaataagcaaggcacttgaacagtttaacagtagattgaagactatagaagaaaggactagtgaatttgaagacagaacagaaaattattcaatctgaagaatacaaaaggaaacaaaggtagtaaaataaacagagtcagagatctgtgggagagtatcaagtagtctgatatatctgtgattgaaagcatagaggtagggaggagagagagaataggatagaaaaaacagttgaagtaagcggtgaaaattttccaaagttaatgaaaaacatccatttacaggtccaagaagattagtagatcaggttaaatacaggtagaattaaaaaaaaaaaaaagaactaaactcagacatcagtcatattgacgaaaaaaaaaaaccatagataatattgaaaacagccagtgaaaaaggaaatataaaatgcaggggatgaatggtacaaacagtaactgatttctcatagaaactgtggaggccagaagacaatcatatgacatctttaaagttcagaaagaaacaaaacaaaacactgtcaacacagaattgtatgactggcaaaaatattcttaaaaattaggtgaaataaacacattttcatctaaaggacagtagagggaatgtgtcagcagcacaagaaatgcaagggacatgatcaaatatgaaaggaaatgagagcagaaggaagctctgatataatgaagtaaaaatagttgaaatggtagacacataggtctaccataggtatattaatgtatatgctttcacttctcttaatttatttggggaaaacagatagtttacaataaaaatgatacagttttattcttgggtttgttaagtatacacatgtaagatttatgactactgtgcaaatgtatgatgctgagtaggaaatacagttttattatagtttttatattttaacagaagccacataatatgaactgtaaaaagattctgataagttatggatacatattgtttatcctaccatgcctaaaaatgaatagaatatagctttaaaaataaatgtatatgtaatgcaaaaaggatttgcttaataaaaaagaagtcaagaaataaggaataaaatgaaacatatggatgtgaaaactagaaggcaaaagcttgaaagacaaccatagaaataatttcaccaagtgcaagtggactaaacactccacttaaagagcagagattgtcagactataataaaaagcaagaatccgttatttgctgactacaagagactcgtcttaaatacagagacacagttagattgagtaaaagagtggaaaactatatcccatatgaatagtaaggataagaaagctggtgtgtctgtattactgtcaaagttgacttcaggggaagaagtattagcaaagtggaaaagagacatttcagaatgatcaaatggttaattcatgaggaagatataacagccctaaatatgtatgctgctaataaacagcttcaaaatacatcaagcagaagttgacaaaactaaagccagtaatagataaatctgcagtcatagttgtagacaaatttgcaatcaacaactctctctgattgaaaaaacattcataaccagatcagcagtgatgtatgcactgatgtggatgaatctcatatacattataaagagcgtaagaggccagataggcatgcatactctatgtttccatttatatgatgctcaagagtagaaaaaacaaatttatggtgagaaagttcagaacactcattcctttagagctttgggttctgactaggaaggggcaccagaggactacctagtgtgatggaaatactctgtgtttgatcggagtgttagttatatgtgtgtacacatttatcaaaagtctttaaatctttattagcctaagccccatgtattgccacttgtttttgtaaacaaaatgttattggtactttgctgtactgatttatctacgtattgtcaaaggctgcttttgcactaaggtaacagttgagtagtggagatagagactatggcagaaaaaacctaaaatatttatgatctagccctttctagaaagcttactaccccttgctctagagtcacttatttaaatgcagcttctgaaagtcaccctctaagattctgatccagaacatctggaacagagggaagcatctccaatctattccactccccagatgactctcaagtttataaaactgtgtggacagaagttgcggaattgctcctttcaagattcaccatatcaacatagtagctactctctttggtcataaaggtattttactgactaatctcattgaatcactctggagttataaaagcccatttcctccccactggccttccttggaaagtgagaaaaattccttctcatcatagttatgtaatcatccttcataaatgtggagaggctcacatgtgctgctggtggtaacacattctcctgccactctctggctctctgtaggcggctgtttgagaggttaaagataggatgaaggaaaaattcacaaaacactttgtatgcacgtctggcggataatgacacttaagaagctttgcttaaaactgatctgccttcgtgatgatttgagcttgctctttaattagcttttaggagcatatattgtttagtatgattattttattttgccaaatagaagcttaacacgctttagttcacaaaggagcgagatctactttataccagcttttaacgaccaattgagagagaagaaaatgtctgactgccctggaacctttttccccatgggtggtatgtgactttaagatttcacgatcatgggggacactttcggcagcaacagcaatgctcagcaagtattcccttggctcttctctatttccagccccctggcagttaggtggagctctgtgactagttttgctcactgaaatgtgtgacttgtccattgtttcttctagcatagaatcatgcgaatgcatgatgcagttaccacagcatgtagataccacagatacggttaccacaggtgtgacatgaagcagcttgaattcctgagctagttttactgagcaggaaattgatgtttgttgcgttcatttatcgaagtcttggagtcacttgttagtatggtatagccttctctttcctgaccagtacggtacctactgccataagttcagttactcactggggaacatagtccaggagtacacgtgaagctagtaaaaaggcaccatttcaaattagcgaaggtggcatggactgtgagttaacagaggaaggaaaagtgactgtatatttgggaggaaaaagtgagatctctttcttcaactatgtaaaaataagttatatcccagcactttgggaggctgaggcaggcggatcagtaggtcaggagttcaagaccagcctggccaacataggaaaatcctgtctctactaaaaataccaaaattagctgggcatggtggcgcatgcctgtagtcccagctactcacttgaacccaggaggcagaggtcgcagtgagccgagatcatgccactgcactccatcctgggcaacagaacgagactctgtctcaaaaaaaaaaaaaagaaaagaaaaaaaagactattgcttttcaaaaggtctctgctgtgcattatgttgtgtaatttttttttttttctgagagactgcctcaaaggatgcaagttattcgtctccatgtcattttaaaaatgtcttctctggaggtatctggatggaagagaaaacttctgtgatgctggggctcaattctcttggggctctctataagacaggccattatatcaattgctacatctagcatctcctgtgctgacaaaagtcccctgattgctccactgccctgcagagttgattgtgctatcttcctcgcttgcctgatactggcttccacgttgctctctctagcatgtggacttcagaggcagagcctgcgttcttcatttttagtgcctatcaggcatgtggctggcactgaacacagggttctgaatgaataaataaatgaaatgcttctaccacttacattccctgcctcttgggatggcaccatgcccagtgcaccaccctgatttaagttagtgtcagtcaaccctgccttgattcctgcgatcacgctatgtttactgttacccctccccattagttctttcactgaagtcagggaagatctgtttaaaatccatatcttatttcactccctacctaaaaccctttggtggcttcccattgctctttgaataaaggcccaagtctttaatgtgccacataggacgccatctctgcatcctcaccttgctcacacctggtagtcaggaaagatttattccttacagttgctgaaacacaccctggtctatcctgccacagggtctttgcctgtgctgtgcttcatgcctcatgtgccccaagcaatagtacacacacacacacgtttgcttacctagtctacttctaaattactgtttagaccccagctcaaattaggggacattcctcttttatataatttgtaatttctttcttttctttttttttttggaattggagtctcattctgtcacccagggtcaagtgcagtggcgcagtctcggttcagtgcaacctctgcctcctgggttcaagtgattctcctgcctcagccccccaggtaactgagattacagatgtatgccaccatgcccagctaagttttgtatttttaggagagacagggtttcaccatgttggccaggctggtctcgaactcctgacctcaggtgatccacccacctcagcctcccaaagtgttgggattacaggcgtgagccaccacacccagcctaatttctttcttatagtattcagcaccccttgtttgcagcagatattgtggttgcagttttacgtatatttttacggttattggattcaggtctgcaagcacaaaagaggatttgtctggtttcagtgtaatcttgcaccccaagaaccgattacaggatctgatggatatccactcaacaaataatcttgtgtaaatgaatgtcttgttaggggtattgtactagttccctgccatccagggatgcatagtaaatctgcctgatcctgtgagctcggggaaacctaaagctttctgcgggagtggtaggtaccaaagacatgacattagttctgccctactcagaaggtatgggctgggacaggcagtgagggggtgaaggagactaaccgtgaactgtcagtgccccct[136 bp omitted]aactcagagtatttcttatgtgaggggtccattctctagcatcttaccccaggcaggccattttttttttattattatactttaagttctagggtacatatgcacaacgtgcagggttgttacatatgtatgcatgtgccatgttggtgtgctgcacccattaactcatcgtttaacattaggtatatctccaactgctgtccgtcccccctcccctgaccccactacaggccccggtgtatgatgttccccttcctgtgtccaagtgttctcgttgttcaattcccacctgtgagtgagaacatgtggtgtttggtattttgtccttgcgatagtttgctgagaatgatggttatggtagtaggttttcagaagccatgcttcagttctgactggctaagcattcagaaatgggtcctaaacagcaaaatatagatggcattccaatgcacccacagaagaggttttcagctgcagaacaggcattctgagttaaaatatctggttgttttctattggaaagcattggctgtactttgaaactctttaggcttcattctgataagagaatgagatgacaaggtaccatagaattcagtgcaggtattattattatttacattttgcatttagcttgttttaatgaggaagagtggtgggagtgtataaaattttgccacttgtcctgaatcccatcatcattttgaggcaaattggagggatcacagattcaacagggtcaggtgtgaatatggggggtattcattggatatttgaatgaaaacattggtctgtttatttagggtttaaaagtatgacttaaatcattgcatttaagtgtaggtaaatcagaatgtctgaaaaaaaaccatgaacactaatagttaatggaacaatgactaatcataaggaataaaaagtgggagtagatttaaacaacaaaaatctcaagtgtggctgaaggtggcaggggaattcctggagatggcactcgtttcgactttttttttttttttttttttttttttgagacacagtcttgctctgtcgcccaggctggagtgcagtggcacgatctcagctcactgtaccctctgcctcccaggctcaagtgattctcctgcctcagcctccccagtagctgggagtataggtgcccgccaccatacccagctaatttttgtatttttagtagagatgggttttcaccatgtcggccaggctggtctcgaactcctgacctcaagtgatctgcttgccttggcctcccaacgtgctgggattacaggcttgagcctctgtgcctggcctgttttgacctttttgccattgactttaggtactttgttagaccattgctaagctcgcgatgataacacctattagaggaagtcttctgaaagtaagacctggagattcggaggcgatgtgtacttgcttccccagcagtccaaggtgtatgtcctgccctcctccggcagggccactaccatgctggctccccttggtttaggcttgactttgcctttgatacaaccttcccccaaggcaccctgtaatcgcagttgagccgtattccagatacgtgtgagccatatgtctcaggtgttgcagagtaggaaacaagttgagacatactgaggcaattacagaaaaaaagaaagcatggagaattgcggtgataagggcttacgcttcattttttatgctgtctcttttctgaccatattttagatttcctagaaactacccattattatgaatgcctgagttctgtgcatttcttcagagctcaagtctaaactaatttaatgtaaattatacatttgcaagtaatattccagaaaaacctttatggggcccacaaagacaaaatgcacaaaaggaaatgatgatgtgttttattcataaggaagcatttctcttcaaaattcttctacagccccccaaaatacctaatgcatcacaagccgacatttgtactgctggctttccatacacagagaagtactgttccttttaatcaagtaagtttattttgctgtgaaaccctttgtataatattgaaaaatagttgtgttccttggaagctatttcagttttctgaaatgatcatttttaatcagtctcctagcaaaacaatttaccaagcagtggaggataacgaaccataaagtttaatttgccttttttaattgagttgttaattatcacccctccaccgctggaaactcccaacttgcttttttgttttgcttctgatccgagacgttttcaagaatctaatctatcatatttcctctgtccaggtactttcatgaatcacatcaataggtgattattttctaaatctgttaaagcttccacagttgcgtacaaattttgtcagtggtaaataattagatagaaaacatccagtggtggtaagttgataaagatatctgccatttattgaattcctactatgtgccagatgctgatctaacttcttaacatatattatttatctttcacagcatttttgtttgttttgttttgagatggagttttgctcttatcgcccagggtggagtgtagtggcgtgatcccggctcactgcagctgccttctcccaggttcaagtgattctcctgcctcagtttcctgagtagctgggattacaggcactggccaccacgcctgggtaattttttgtgtttttagtagacacggggtttcaccatgttggtcaggctggtctcgagctcctgacctcaggtgatccgcccacctcggcctcccaaagtgctgggattataggtgtgaggcactgcgcctggtcatttttttttttttttttttttttttttgacagggtctgactctgttgcccagactagagtgaagtgacacaatcatggcttactacagcctcaacttctggggctcaagtaatcctgccacctcagcctctcaagtagttggatgtatgcaccatcacacctggctaatttttaaaattttttgtagagacaggttcccactatgttgtccaggctgctcttgaaactccggggctccagtaatcctcctgcctcaatctcccaaagtgttgggatcacagacatgaacccgtacaccaggccttcacagcattttgaggtacaaacagttatctccattttatatgcaactaaactgaggttcagttatgttaagtaccttttccatcacaatccaacttatcaggactggagcaacgcttcaatcctaggtggtctggctagtggcctcacaggttatttgtttaaccctaagctgtatttttgagatccctgatgtcaaacaaacctgcatttgaattctagttctatcgttaatattgatattaaattaacagaatatgacttagggcccatttgatgggtgtgcggtctgggcccctgcccagccacaccctgcacttggtttgatgttctgctgttgcctttctggcaactctaaatcattttgaacaagggggccccatgtttttattttgtattgggtcatatgtaacataggtagccagttccaataccattattgttttaacatctttagaggctcataaggctgaagtcaacgtgtcagcctggttgggttcacatatggtggcttaactggtatagatctacttccctgctcatatggtaacattcagttccttgcagtcataggatttgtggcatgtttgcctttttaaagccaggaaggggagagagaacgaccagggcaaatctgctgggaagatggaatcttatgtcagataacataataataggagcaccatggtggctcacacctgtattcccagcactttcggaggctgaggcggacagatcacgaggtcaggagatcgacaccatcctggctaacatggtgaaaccccgtctctactgaaaatacaaaaaattagcaagggttggtggcaggcacctgtagtcccaggtacttgggaggctgaggcaggagaatcgctggaacccaggacacagaggttgcagtgagccgagattgcgccgctgcactccagcctgggcgacagagtgaggctccgtctcaaataaataaatacgtaaaagagcagcatccaatcaccttcgctatattttattggttagaagcaaattacaggacttgcccacactgaagaggagggagtcatacaaatgtgtgaacatcaggaggcagagattgtggggcaccatcttgaagtctgttacctgcaattattattattactatatacagttattagtgttgtttttattaccgctattgttattgatagcagttctatagagtactgtgtcccaggctctgctgtgtgagctttatgtgaattaaagctttctgtgttcagcagggaccatggtcctgaggactgaatccaaggacatcccctctctgcccactgaaatcagtagttttcaggccaactaagcatgaggcaactgttattttcctgagtgatacgatcgtttcaggaagtataaggaggtggaaacacagaattctgcatcacacagaccaaggtgaggtcccaactctgctgctttctggctgtgtggtcttgcccaagtcactttctccatgtgggatgttccaggagacttttgaccacccgctgcaagagaaatctcttacaacctgcccattcagcacagttcagcctgaagagagtcatgtgtttgtatttaagatactattaccctgctcaatcccaagagcccactggtctcaggctctgcatggtgtttgaaacaaaaaaacacaatgaagaaatggaaaagttatcccccaaattgtcagcacccatgtaactgctttctcctctcctctgtgattgtccatgaatatagattggcttggccatgccatcttttctctactagcctctttcttgctctcttcctcactctttctgtttcttggtcgtttttttcttgatttctccttatgtatctgtttttgtttctccttctcctgtcctgttccccatttttatccaaatgccatgtcagtgattctcccttctcaggaggaaggaagcagaaaagggtggacaaaggaaataattgaatagaattccatcagtctctcttagcaggtgtatctctgaagctcttcaaagatggtcttgatgagagcagaggaaggaactgctcctctcaagattcagctggaaaaaatacggaatattgtgttaatttgtcttaccaaatgctcttctccccacgttttccctttgatttctctgaatgtttgggaggcatgcattttgctgcagaagagaatcaagtcttcttacaccatctttgttaagatactactgtctgataattcgtaaacttctaaggttttttttccactggaaatgacttttttttttttttttcttttgagacggagtttcatgcttctcacccaggctggagtgcagtgactcaatcttggctcactgcagcctccacctcctgggttcaagcgattgtcctgcttcagccccatgagtagctgggattacaggcatgtgccatcatgcatggctaattttttaatattttttttgtagacacgaggtcttgctgtgttggccaggctagcctcgaattcctggattgaagtgatccacccatcttggcctcccaaactgctgggattacaggtgtgagcccctgtgcccagccagaaatgcttctactttctcctgtagggtggcctgtagcaggatcatccattcacattcccaagtatcctctgttcattcacctgggcaatgagaggagcaacaattaagccagaaaagatttgctgcctccctgtcttgatcccaactccttccctcctgtctgtgtaacttggatctcttacttgtcccctttgtcaaggatagagtcaatcccattccttctagtagatcttcccttctggcccaggagtacctcatcctataagcaaaacatctttagcatctttcatttcttcaagctgtgtttccttctcacttctgaaaaaagagcaatctgtggtttggtttcttatctctggtcacccatttactacccttttaatctgagtgctgtgcaaataaccatctcacaggtgaccaagggacactccagtggtcaatgtgtagtctcagctcgtattctccccaagctctctgcagcgtcagaggacactgacccacactgtgacttgactctctgccctcccacattgttgtgagactggagctctgcgtcattttcatcctcttaattctctgtgtccatccccatgtcttctctctcaggcacaggctaaatggaggtggtgctcctgaacttgaccctcctttgtctttttgcatttccctgcagtaccttagcccatcaccatggccgctgcttttggagcaccttctaaatgtcagcctcttttctcagtgccctccatatgtaaacccttctaatcctccctaacactttatgagataaaaatgagggttgttcttttacaagggcgatacggaagagctgagaggctattcctttctttcagatctctgggcataaccctgactgctctcttagattgtctttgatttctgcttgtcgcttgtctcctccccctgggttatctgttagggaccacactcaaaaccaaactcacctccatttctcttccaactatgttcatcctctgcgtcctgtggttttgttcatatactgctctaagttccattcaacacttcctacatcatttttgtgacttcctgtctttccctgcttgtccaatccaccactaagctgtgtttatttcactcccaaatattttcctttctaatttcttccaaattccaaaatattcttttcagccctctttaattctcttactgtaatattacaataagtttcttttaaaattaatttcatttttctccattgtgtaattattgtatgctgatctatttggagaaaaggtgaaagaactcttttttaaaaatctgtaatctcagcacactttgggagggtgaggcaggcataacacttgaggtcaggagttcaagaccaacctgaccaacatggtgaaaccccatctctactaaaaatataaaaattagccaggtatggtggctcatgcctgtagtcccagctgctcgggaggctgaggcagaagaatggtttcaacctgggaggtggaggttgcagtgagctgagatcatgccactgcagtccagcctgggtgagctcaaaagaaaaaaaaaatctataatctcatcacctggaatactgcttcttgcttctggcctgtcttacttctcgatccctgattaatttctctaaaaaatcagcttttctatataacccccttcagagatccttgttgctgctgctgcaaaaaaaaaaaaaaaaaaaaaaaaaaatccaactcttttttttttttttggagacggagtcttgctctgtcacccaggctggagtgaaatggcgtgatcttggctcactgcaagctccacctcctgagttcacgccattctcctgtctcagcctcccgagtagctgggactacaggcgcccgcctccgcacgtggctaattttttgtatttttagtagagatggggtttcaccatgttagccaggatggtctcgatctcctgaccttgtgattcgcccgcctcggcctcccaaagcgctgggattacaggcgtgagccaccatgcctggccaaaaaaatccaactctttagaaaaacactcagaacattccaagttcccctagaagataactttcaggaaggcaatggctctgccttttgaccagcacatagatgaatgccagaaacagagtgagtactgattggttgaatgaatgagtgaatgaaggaatgagtgaatgaggaatccatttaccttctctaatctctggcttcatctagaccaaattactgccttctcctaaattgttccatattttccacttcttctcacttactgttagtagctgagatctcctcctgtccatctcctttttgtttgtagatcgtctctgtcattcaagactcaactcattcttcggggcttcctcaaaattcccctgatgttctctgactgcaaggagctcttccctctcttccctcctctgttactcctgaagcagtttttagttttcattctaattcctttctcccagctcctgagcaaggtaatagtattttttcagctcggctcttggtagatatttaatatttgttaagtgcatgagttcatgaaataaatatttgggataatggagctgaagttaaaaccagtaagctccacttacttctgtgtctgggccacactttgtccaaagatttccctcttaacgtttttgtttacaaatgctcttcaggaataacttgtaagagaaaggagctgtcattgagtgccttgaaaagtggaattgcatgtttctatggaaacagagttgagagctgagttttctgtacatgatgttttaatgaaaacatattcttagccattatagatgggtttgtgtaccagatgagaagtgctttatcttaattgaccattatgttcataagtcagattgatggtctcaagtattatttcatcaaatcacaatgcattactgtggtttcctttcaggaggtgatcccaatgctcacaaaatgaaggctgtccttgtttgtggaggaaaatgtttctatagacttgctgttcttccctttgctattgagaagtggcctctttatttatagctaaaggacacttaccataagcatccaagtgattctgttctctcttggaggatgataattgccccaaatcatgcatgtatcttatatcatatgaacaattgttaagcagttttagggactccaggatggtggtagcagcggtagtggtggtggtgatgtgggaaagctcaaagtttgctcccaaactcttaagtagaagactacctgtgcacctgatacttttgcttttcacttgtgtgtttgttggttttgttttttagagacagggtcttgctcttttgcctaggctggagtacagtggtgcattcactgctcactgcagcctcaaactcctgggctcaagcgatcttcccacatcagtgtcctcagtagctgggactgcaggtgtgcaacaccatactcagctatatatatatatatatatatatctctacctacctacctatgttgtccaggctggtttcgaactcctggcctccagtgatcctcttgcctcagcctcccaaaatgttgggattacaggtgtgagccactgtgtgtggtcacacctaccatttttggtttgtactagttctgaagcatgtattcctatagcatggatcaacaaattagactctacagattatatccattagaatgccatggactataagtgctgggatcataattagaaaattattctctttttaattttctgttaatgataatttattaggcatattgttcctatccagagatgggcttcctgcttcagtttgtggcaaatttagggtaccattttgcttacctcttggagatctcttttaatgcagagatctaacacatcattctcctcaagtaccttttaataggaaatttcccaataaacctattaaaagcataatgaaaacctcattcagtcttctgtcaggctttggagctataagtggcttctaatttgcacaagatcggaatagcattgaagaattacagtaactaagtgaaacatgcattggattttcaattttctgatagcatcccatgtaatttcttgtaatgcatctgtagccaagggaggtgacacatgtcaaggctcacgctgcagcttctgcccacatcagtcttccgtggagaagcacgatgctgtcagcttttctcatgagcaggggccagataggtgtctttgtttagccttgatggatattccattatgcacagtcctctgagcaatagccacataatttaaaaacagctcagatagatgtttttgatgcttgacatttgacttcacatatttattggaacaaactgtgaatcatccctcttatgcaagtgcttgacagaatagtttgtccacctgtggtctgttgtacctgtggagtctatttgtattctggaaaatgaattccctctaggaaaagccaagagaagtcctggacatcatggctacaagccagtgagataagaccctgcattttattttttttaatcatagtatctcttttttttttaactttaaagttcatgggcacaagtgcaggtttgttacacaggtaaacttgtgtcatgggggtttgttgtaaagataatttcatcacctaggtattaagcctactgcccattagttatatttcctgatcctctcccatttcccaccctccaccctaggaaaggccctgggtgtgttgttcccctctatgtgtccatgcattctcatcatttagctcccacttataagtgagagcatgcagtatttggttttctgttcctccattagtttgctaaggataaaggcctccaactccatccatgtccctgcaaaagacacaatcttgttttttttaatggctgcatagtattccatggtgtatatgtaccatattttctttattccatctgtcattgatgggcatttaggttgattccatgtctttgctattgtgaatagtgctacagtgaacatatgtgtgcgtgtgtctttgtattataatgatttcttttttggggagtatatacccagtaatgggattgctgaaaatcctatatttcctttggcatatttcattttatccagatgaaattatccactttccctcttagagagcctaaatgtttgtttttaacctgaaagagggagtctcttgtaccttacctgtagtattttcaatgtttatggcatacgtccattatttaaaacctcaggaggagaaaagccagtagtatatttaaaaatagactaatcacagtttgcaaaggaaaaaaagaaaaaagaagccaaccagactttgtaatcattaaaataattaatggtgttgcttttcttgtatgtggccttgacaagactctctcactcctggggcaggtattttgactgatttttcacctgactgaggatgaatttgcactaatccagctctatactctcccaggatctcctttgtgaccaaaggcatttatttgcaaggtagcagtgtggaggttaagatgataatctaaggccagagacagcgtccagctaattggctttacatggggatccaagctgtgttctaactatggtgcttacgtagcctgaagcacctttctgaccctttatatcaccccgaaaacagcaaacatttgttgaattcccatgggtctggtgctgtgggagggggtggaggcaggagaagccaggagagactcagcttggcacagcaggagcttcttgggtgctcacagcagataggaatccacgcttctttttaaaatacactgaagaaaatattatttgagtctttccatttttagctgttcaatgggtgataatggaaagtaagtccagattagcctccaaaattgtagatcagctgttttcaacctcaacactattgacatttggggctagatgattttcactgtgggagctgtcctgtacattgtaggatggttggcagccgtagatgctggtaaaaccccctctagttatgacaaccaaagagtgccttggctgagaacccctcctctggatggcttcccagtggctactgatactggcattttctgcttttagagagagtaggtgactgttttcacaagtgtaaaatataaagtccttaggacgatgctgggcatggaataggattcaaaagtaaaagggcaaacttttcactatactgaatcaagctgttatttttttgaaagtgatatcatcatctttgctgttcattatacctttactgaaccttccggagtgtccctgtcttaataaagaagtgagcatcgtctaagtactgttttgagctttaagtggcgattcaagctccacctcgttgcagaaacatgggcagtaaaactgttagtatctgagaggcatcaagaaatggtagacgattctgaagcatggcatcacgtggctcttcatgtttatctcgccacaacatccttagctcctcctcctcccactggtcgtgcattaaagcttcaccaccccaagggccatctgtagactcactgcatcagcatcgccttgggagcttgttagagatacagagactcaggccccagcttccacccacggaatcagaatttgcatggatagagagccagagaaatactttgttgaagggccttttccatcccactccaactgttacctaaaaggacctcttcagagcctcctttcatagatattctgtcttgctggctgcatgctctcttagcgtcctctgctggccgctgttgatggtggtgattgtttttcatacttttccttccttaccattctgtgctctcataagtacaggccagttttgcttttctgtgatcccaagctatgacctaacacaaccctttcccatacagatccagtcccaagcacccgggagcattccagggtccctggacatggttctgcaaaactcctagctactcagcatgccagaattctaattcactcatgggtcaaagccagagaggctgtgtgtccacctctacacatatgtacccatgttgaatttaaaggtccccaataggagctacctcaaaaacacccaacaattaaaactagaggggatgggggcaagaaagatgaaaagaaattgattttcaagatgccatcaaggttggggaaaaaaagaaaaaaacaaggaatggaagggacatcagacttaatgcctccttgaacatgttacgttcaactcaaaagcctccccagtcctcgcaccaaaatctttcccaagtttgtaattggtgtcaccatccactcagttgctgaaattaaaacctaggcattatgattgattccttctttctcctttcagtctatcaacaaattgtatgtttctaccttcaaaataagaatctcaaatccccccacttctagtcatctccattgctatgaccttgccttcagtcccagctctcaagggtctcctacagccttctcctaaattgatcttcctgatccactgttgccattctcagaccctccctttggcagaagccaaaggctggtttctaaactggcagtgtagactgggcacggtggctcaagcctgtaatcccagcacttcgggaggccgaggcgggtggatcacctgaggtcaggagttcgacaccagcccggcaaacatggtgaaacccgtctctactaaaatacagaaattagccgagtgtggtggcatgtacctgtaatcccagctacttgggaggctgaggcaggggaattgcttgaatctgggaggtagaggttgcagtgagccaagatagcgccactgcactccagcctgggcgacggagtgagactccgtctcaaaataagcaaacaaacaaactgccaatgtgctggtcatacttccttgttcattttgtttcacttttctatttctcaaactcctcaagctcattctagtcttagaattttgttctgctcccacctcctggaacactcatcccccagctactggcatggatggctcattcttctttgagtctcaggttgaatctcaccaccctcaaggcaggaaaaccttatcaaattaggaccaataagagtcatgttcctggcacctaggtagtagatgaatcccctttgactaaggctacctcaccgagtgactgtgttctctaaaatgctggtgatgtagaacaggcaggacacagttagcatgggagacccagctagaaaaagctggagagatccagagtaaagttcatttgccatacttcgctttatctaatagtgagaaagattgcctatcaattaaaaccacaagggtggagtggggatgttttccctagagatttgaagtagtttcatctaatgtggagcagttttagaattcaataatgcaatcaggttttagtatttccacccccctccctgccacgtaatgattcatgtgccttgaaattttttcattaaaaaattccaaggctcacaacgtagaagaaaaaaaagaaaagggggcctcacacctcatttgttcagccatctcatcgaggccccaaatgtagatcattgaaatggagccttggaattttaaatcaagttttactttgcaaatttaatgaaatgcaaacaaatacttagcagttctaaagggcatgaagtcattaaggtttctcattttgttaggcgctttgggggcctccttaatttttggagtaaaatcaattaagttctttgtgtgtgtatgtgtgtgtgtgcgcgcgcgtgcgcggatgtgtgtggctgcttgtgtagccagtaaatagacgaggtgtactttggatttgaatgtctgttgttccctttaccagatgtgtgtccttgggcaagtaacttaatcttgcctcctatgtaacatgaggaacattgaagttttgctaggaggattcattgcagacgcacaggtttctgttcttagaagtacccgtgtatgctttaatgctttgcttttaccatcttgaaattcttagtaattattccgtgatgggacatgcattttcatttttacataaggccccagaaattctgcagctggtgctgactgggtgaaataatgtgagtaaggtgcctgtgagcatcccttagatgaggcagatgctagatatgcattgggtctttttcttccaggtttgaatagctgtgtcttgctgctttcctgggttgggcaaaatgtagaatactgacactttatacagccacccccataagagatgcaggttatctgttgattacctttaagactggagaaagatagtcgattctcttacctgcactttagcaatgttgggaggatagaacttatttggagaacgtttatggcctaatagcttggtaaaatgtgaatcttcatgaaagtggtttgccaactctaaattgctatacaaataagtcctgattatgtgcactgaacaaaaggcttattgagcagtaactgattcagatggaggtaagaaaatatgccaaactcttaggggatcgcagacattcaaaatcatagctcctgaaatgtgagcatttctctgtcaattcagcagatgtagagcgcgattctatgcactgtggggcaaggtgttggaatggtagatgatgaaaaatcatggcttttggtcataggaaattatgtgatgttagcagcctagagctcacagctgaggctgctggaggtaatgctgagaggaagcatatcgtgagaccagagagggttgaagagaggatcttgagatctgtgtgcacctgaggtcctcaattttggattaacagaatccccaggaagtttacccagattgttatgacttttacccagagtgagaaccatcattgattaacacttaaagggcctggcagagaaccaggagagaagagttgaagttgtgaggatctatctcaaggcatgtgtaaacaacagtgcccaggtgagaagtggagctctacttctggaaattctttcctttctgttttccattaaaaaaaaaataagataaaattagtgcctatgttgaccagctctgttctctatgttttccttcccaaatgaaccaaatgaatgctagctcttgcaaggccaacatcacagagaggtgttattcctgtccccctttattttctctgcatattctgtttatttcacccacagcatgacacacttacggaaattatctcattgctggtcctaatgatcttttcccttcctctttccacggctggaatctaaaccgcatgagagctggggaatgggtcttgtttatctatctctctatccctaagagctagatttgtgcctaggacatcagaagcctccacatatttcttgaatgaatgaatgagccagttttcctcacctgagaccatttgcagcatgtcaggttgtcttgacgtgcagctgaattatttacattttccggcaattcattgattgacaccttgggcgccctacatttgtgctagcctcttggtattttttctcccagcttagatgttcctgctgttctccaggatgggtccttcttccttacagattcagaaaggagaatcttctatgaaatctacaagatcctactagaacgtcaggtctgaagggcaggactatgactatggtttccttattcatcatccctccataaatacatatttgctgaatctcttttcctcccttactcttcctgtatatagaagaggaggtggacatctatttggggtgttctcccaagtttgtggccaggcttaaggaaccccgcgacaccatttgttttcaggaa[134 bp omitted]ctgctgcctcagcctcccaagtagctgggattacaggcgcgcttcaccacacccggctaatttttgtatttttagtagagatggggtttcaccatgttggccaggctggtgttgaattcctgacttcaggttatccacctgccttagcctcccaaagtgctggggttacaggagtgagccactgcaactggcctataatcagtcttttatgtcattctccatcttcatgcatttaatagattacagcccaaatatcacaatcgtaattgaaacagatttgtttgttagaagagggggaggtattaatgaggctacacaggcactgctgtgaaccaggaaaactacacagtgtgggtatgagggagtgaagaatacatttatgttttaggtctcacttctttctttgcctgtattaagtagtaagggggagaactaacaaggtacctctgcatttaatggttcttttgcagtttggctgaactgtgtcttgaaatccttgaagagcattactaagatggtatagaagttacttgcttaaaaggagaaaagaaaaagctttaatatagacaactcaatagctgaactactcttgcaatgtgaatagccattccttgggtttctaaatgattttcacacttcccacacttgtttaaatttgtaatatcctttatggttttcctttattggccaggagaagaaaaacaccctgaagatctaggtatccatcaaagctgatggaatacactaataaaatcctgtgtcatattaaaatgtaaaatatatgctggcataatattgtctgagtcaatccaatggaataacataattaatagtggctttgataattaatttataggaggaagaagctgaggacagcttagttctttctgtctctgtattcctcccaccccctcatcttttctcctgctctctgtctttctctctctctctctttttaactagctgctgtttgcttcatccaaatatgcatggaaaagttttaagtggttgttgaaactcccagaggcctgtttacttcaaggtagaagcaggaaagctgccataattcagaaagcagcttctggcatgagatgaaagtcagatcagctcaagttggggtcagaatttagaggccccactggagtgtttatgcttgtatctgtagtccagataagttagtggaagaaattgttccctgtggcaggtcatgaatctaattacactagaaatattactacaagcgcttcattgaaaattgctaagcaatgtatgctatctatggctttcgtaccttcaaatcacatatgatatgtggaacacatcttccacgtgggcccacagacccataactcaagccatggtttctcagcagaaaacagaccccagagagctcctgttcctgaacatctgtctaaaaaaatgccctcttagagatgagagaaacagagaccttacttgaacaaagagagaggagcactgaagtctcaggagctgatcaggaaacacagaaaggaaataagtcgatggttttaagagctagctcagtgccacccatgttgcaatgtaggttctggatctaggcctttttcctgttttatgactattggatatctctcttaaaaggggcatagttattttctgttttttttttttttttgttaattttatgtattttttatttccataggttttgggggaacaagtggtgtttggttacatgagtgagttcttgagtggtgactcctgagactttggtgtacccatcaccagagcagtataccctgaatccgatttgtagaaacactaagcaaaagaagttccagaacagaattaaaactatgcagcattcctatttcctccaataaaaatttataattgacccttgttagcaaaaattttcaacaatggaaacattgagaatattcagtaaaacaaaaaacaaaaccattttgaatattaaatataaaatattgttccttgctaattgaattcttttttaaatatggaaacacacaattgctttttattaccctttcatttttttacattgttttgtatttgttcttatattcaaatgaacaggctattttcaagttaacacacagtcccactccttcctccaagttcccaaagtccattgtacgttttttttttcccccttgggatggagtctccctctgttgcccaggctgaagtatagtggcatgatctcggctcactgcaacctctgcctcccgggttcaagtgattctcctgtctcagccttcctagtagctgggattacaggtgcccaccaccatgcctggctaatttttgtatttttagtagagacagggtttcaccatgttggccaggctggtctcaaactcctgacctcaggtgatctgcccacctcttcctcccaaagtgctgggattacaggtgtgagccaccatgcccggcccattatatcatcttaggcttcgcattcttgtagcttagctctcactgatgagtgagaacatacaatgttttgttttccattcctgaggtaaggtgacctcgttctaattttatcaaatacagtatgtcaagcaacaacacaataaaacaaatgggtatagttatatctggtttgaatagaggctgtgggttcaaaatgaggataagtccagacctcatggaaacctccactggcatagcctggtgattcacacaggaagggttttgaaatcagatgttcctgcgtcataatctcacgctgacgcttactaagcctgtaacatcatgcaagccagttatctctcagcctggacttggtcatctgcaaaatgggtaactgtcacattacttgccttgcaaggttatcaggttggtacaaaagtaattacggtttttgcttttaaaggtaatggcaaagattgcagtcacttttgcaccaagttagtataaagataatggtataagcaaggttatgaataagtattttctatgttgataattctagatcagggtattgtatgacatgtaggcattgtaactgtaaaataactatgacgtaggcagggtattgcatctgaataagccaggtagtgaatctattatcctacaggtagattctttttttctgtaaggtctttgaggtaaggtaggaataaggatagtgggagccagcggtgatgaggatgacaagatggtctaaatcttctccctctctggcattattgctgtttatttccttggagagagaatctactcttggtattggaatcagaagcagggaaactaagggaatgaatatgaatgtcaaagaagaaatgggatgcgggtttgagcaaagaaaatattagttaatgaatgttttaggaaatttgcaatgtctggaaggtaaacgtctttctcattactaatgtgactacaggtcgtactgtgtgttaatttgaaaatagcctgttcatttgaatataagaacaaatacaaaacaatgtaaaaaaatgaaagggtaataaaaagcaattgtgtgtttccatatttgaaaaagaattcaattagcaagcaactatattttatatttaatattcaaaatggttttgttttttgttttactgaatattctcaatgcttccattgttgaaaatttttgctaacaagggtcaattatataaatttttattggaggaaataggaatgctgcatagttttaattctgttctggaacttcttttgtttagtgtttctatatacattttctaggtagaataaaatccattgtacatattttaaaaaggaaaaagtagtccggagtgagtccttcccattgactgctttggacattacaatctgccatctcttcctctggggcatccaggagacaagccctaggagactgagacatggaatggtgatttcataataaaacaagagacaacagggcaattcagtgttcagcgccgtggagctgtgcactgttgaggaacacatcagggcagcctggcccacagatttagaaacagagtgagactagaagggccatctgctgagtaagtagagacctcaagatgtacagcgtgtgttttatgatccggaaggtagattttccccccgttcatgtaaagcacttcaaggacttggtaatgggacaaggagcttttaacctccaggttactggttaagaaatgtcccacatcgatagtgaccagaaggcattgccgtctgctggctgcgcagtggcctatgtaaatgactttaaggtctcaaagcaaaccattatgggccgactttctatcccaccaactcttaactccgagtacaatgacccagactcagactccttgaagtagtccccgtggagcctgatgggaggacggcaggtggctaacagcggcggcttccatgtgggactctgctgtggcaatgtttttttttggaactcacttatttttatagtttaaaagaacacactttatttttcactctggtgagagactttttaattatgtcttttgctgagcatttcaagatggtatcagcatctgacatttgaaatgccttctttgccaggcactctgataagtgcttaacctgtagggtatcatttaatcctccccactcttcgtgagttagaactctgtttcttgttttataaagtaggagactggggcagagaaaaatgaggagatctgcctgaagccacagaagcagggtaggattcaagacctcccctttgtttagctaggattcatgttcatttctttattccatccaattttctaaaacatttttaagaatcagtgtccctttatgtttttcctaatagaggtttctgtgacctcttagcacacatgaactaatgcaggaatgtgcagacactgtccgtcaccttcctcacagttacctctcctgcttcccccacagctaatggaacattgattttgttaaaggattgggaagccatttgtttcacaggggccttttctagccccacccagtgaatcatggttggctttgactgatcgtaaaatgctttgaccaacaataaaacatttccttgccagtgatttgtcttggatgaacatgcccatgtatgtgaagagctcagatggggcatgcccttgagaaggtttcttgatcttcacagagctatagaaaagagaatgcttattttctttcttttggcaaagttgtgtggggagctgttgagtccaacatgtaacagtgagacgaggtggccagcttggccacctgtgggacaatgctgagggttgtggggggatccaagaggacttccctccccacttcccagtggccaactctgccactgacctgagttgttttccttccttgtgtggtagcatgggtgaaaccagagacgtgcttatttcagtccattgggggctcttgtgttactcgtaactgggcattcttgctgaaatgggtagtctgtatactatgtttatttaaatgtattttatttcttattattttaagagacagggtcttcttacgtcacccagactggatggcaggggcatgattatggttcaccatagccccgaactcctgagctcacgtgatcctcccacctttgcttctcaagttgctgggactgtaggtgggcagtgactaattgtttttcgcatttttttgtagagatggggtcttgctatgttgcctaggctgctctctcactcctggtctccagtgatcctccaccatggcctcccaaagcgctgggattagaggtgtgagccaacacccctctaatataaataaatcattttataaattatttataaaaatttatttttatgatttgatttatttatattccctttaaagtgtacaaataaaagagacataaatgtagaggtgatgatacaactttcagtgtacacagcaaacaggtggccaaggtaagcccagaaaccatttgccctacttctctgggcaaatggttgccagatacaacacaggatgcccagctaaatttgaatttcagagagtcaatgaatatttttccttagtatcagtatggcctaaatatttcatgaaggcctacttacaccagtcatttcagttgtttatctgaagtgcaaatttagctagactttctgtatttttatttgctaactgtggtaatcctattctgccaggactacatgctttttatcatttgtcttcctatttttggactcttatttgaaaatactaaatacccagccaccactaacttaagccaaagaagtttatttgtaagcttaatttctaggtgtaatttatatgcatatataaatacaagttatatatatatgcccatatataaaatgcatacataattatattgtaattatatgatgcaaaattgaatgtataggtttaaataatttataggcttatgtaactctgctctctgttatatttcttgccaagtggattttgctaagataattatcagcaatgttagacttatgtcctatcatctttgtgaactccagtgaaaagaaagctaccttttttccaagagttgaaagcaccaagattagatcctattggatggatttaagtcatatgttgattcctaaactaattactatgagcagaaagatgagatatactaattggctgaacctggtcatgtgaccacatttgaagatggaggataatgatacagcaaatcatatccaaaccaatggaaactaggagcggggagattccccgagataaaacccgaacgcttttacaaaatgaaagtggagtggcttctgggcaaccaataatgatgtccactttagtcactaggtatcagacacaatgctggtctgaagaatgtgatgcttgcaactgtccggcggggccttggacttgtctgaatcggtattttgctgaaagtgggtggagggaagtgaaggttctgcatcacaggcgatgcacctacagcaatcagatatttgtgaacaaggctgttttgttctgtgtcagaagttcagtggggttcagcttgttagtcaatagtgaaggaaataatggcagcccgttccagtctcgccgtgcctgtgaggcctcctttgatttttccctcgtaaagaatctcatttgatttttatataaaactcagatttgaattttattggagtacttatacatgattgcctttcagtgaaacttactgtcattttagccgtaatgttctagcaaatggagtggtgttttttagtttcttttaaattgtttcattaagcaaatatttattgaccactgcacatgagttaggcattgcggatgacagagaaaaagtcagacaaaagtccatgtcttggagagcttacctgaagacattttgctgtgtgtatgacagaagtaaacggtccaagtttctgcatttaaatattatgttctctacaattatattgctctgggaaactggggagagggcacgtctgggaatttgaattctaagagagaatagacaggcacctattaaaagtgaagttggttttctagctttttctgactaggtgaaatttctctgtcataggtttgttttttttttttgagacagtctctctctgttgcccaggctggagtacagtagtgcactctcggctcactgcaacctccacctcctgggttcaagcaattctcctgcctcagcctcccaaggagctgggattataggcaccgaccaccatgcccagctaattttttatttttattttttatttttgagatggagtctcattctgtcacctaggctggagttcattggcgtgatctcagctcactgcaacctctgcctcccaggttcaagcgactctcctgcctcggcctcccgagtagatgggtctatagacgcacaccaccacacccagctaatttttgtatttttagtagacacggggtttcaccatgttggccaagttggtcttgaactcctgacctcaggtgatctgcccgcctcggcctcccaaagtgctgggattacaggcgtgagccaccgcacacggcctctgtcataggtttttggggggagaagctcctttcttcttagtggttggaatagttgtgagcaaagaatgctcaaagatgggcattctttgaggacatttgtgttcaccagaggacagcaagtgcttgaaggcagaagccatccagttccagtgcacacagcacagggtctgccctaaatggagaacccaataaagacttgttgaatggaggaaagtttgccttcccctcctgcttttttcactctggccattgaccttcccacgtctcagacagatgaggaaatgtcatgttaatatcaagaagtatgtacagtgaatgtgctcttaacctcatttttctgcagcttcattctatgtttccttaaagatttcgcagggatgtgatttggttccacccattgcccacatgtacaaaaatgacagaagactgacttgaagtgggcatgcaaagtaacattgcttttccaaagtgccaagaggaggatattcggtattaaatcagtatctccttaaatttgtgctgctcttttcttttgccagccttaaggtgctttaataactgtgagacatagtagccaggtgcttcctaagggaacctgagacttacttaaacctcttcccaccacaggtcaatagaatatacctgtgattgttcttaccttcagtgaagatgcttatgccttattgaggcatttactgatacaaaaaaatgccaggccagtctgacatcttaacctaaatctacagggtttataaggtaatgtgtacctgcaggaatattttttcctaaccttaattaaatgcaaggggaacaattgtaataggagtgccattttagggaggaagtaggaggtctgatttatggctgtcaattgttgcctctgtttttttcttaatgtgtatatttgaggtgtatgcaacatgatattgtaggatatatatagatagtaaagtggttatgatagagaagcagattaagatatttatcatctcacaaactttttttctgtgacaaaagcagctaaaatatacttgtctaaaatagggaagtcaaccttgatgcttcacttcccttttgtatctggggcttgctcacctcttggcccctccagcaccatcaccctgggcaaacaccgtcatctttgagtcattaccaccagagcctcatacacagatcctgcatctagattctcctccatccagcccgagtcatgctttaaatgcacgcatcttctcctgtctgttcccagtggctttatcacacaatggttttgtgagaacaaagctggaggtcctcatccttgcttgcaaggctctgcataacctggtacctggcaccactcccatcttgcctcctgcaactgcagtcgttcctctaggagccatccttattccatcccgtcttgggcctttgcacttgctgatctctcttgatcctctcaagatcagctctgttgtcccatgaatgccttaatctcgagtgtcctttcctcagacagccttttctgagattgccctcatcgctctccgcacacgatcctgctttatcatatcatgactagaacattcgccccttgttcatttgtgttctatctctccttcttcctaccgacaatggaatgcgagctccatgagcacagtggtgtttcccagctttattctgcagccctgccccttgaacaggctttaataaatcattgttaaataaataaatggagaagtgatcactggctgggcacagtgactcatgcttgtcatcccagcacttggggaggccgaggcgggcagatcacttgaggtcaggagttggagaccagcctggccaacatggtgaaaccgtgtctgtactaaaaataccaaaattagcttggcatggtggtgcacgcctgtaatcccagctactcagggggctaaggcaggagaatcgcttgagcctgggaggcaaaggttgcagtgagcgaagattgtgccactgcactccagcctgggcgatagagtgagactctgtcttaaaaaaaaaaaaaaaaaggattgattagttcgtcagtaaattatcttactctctctccatcccattggctggggcagctgactaacaaaatagcccacacaagggaagcaggggttttgtcctgcagagaaaacctcatagaatttaacatccgcatccaaacataaacactcaggaaatatgtctggaaaggaattgcatggcatctgcttccttccatggtgactttcaaatgacaaatgcccaacatcatttagggtggtagagcccctttgaaagagctggagctgattgcttctatcatgcccagaaaaagtcattgtcatctacacacacctggcttacatttggagaaaatgagcttctggtttctgtcttgctccaagattgaaatttccgtgctttgtgttactattaccaacagatacttttcttttgtgaagcgtctagccagctccctaatcactgggaacaaactttgagtaggttgaaccaaaggaggtgtcagagtacatgctttccagccaaataaaccttcagaaactgcaggggctggaggccctctcagtccttcacagccaactaagggtacttatttttgaaagttggactttttttcttagttattaaccagcattagctgcaaaagcattataggaaagaaaacgccttttctatgaaggtcagattcacacaatgcagatttccaaagaacaggatttctgtatttttaattgtttggttttggagactgggcgtcactctgtcacccaggctggagtgcagtggtgtcatcttggctcactgcaacttccgccttccaggttcaagcaattcacctgtgtcagcctccctagtagctgggattacaggcacaccactacatccatgtaattcttgtatttttagtagagacggggtttcaccatgttggcaggccagtctcaaactcctggccttatgtgatccacctgcttccgccttccaaactgctgggattactgtcgtgagccactgcacctggcccagatttctgtattttaacaggaagtgccaggcatgcttatggcttgatttttaagtgggtggtgcatctatataaaatgtgacaactattatctgtttaaggaacgaaatgcagggccagtgaaacatagatgactctcagtgaaatactgcagaaggtggttcttccttcacccaacaacagtggtaacagtgtttccaaggaaagaacaactcaagggagacatttaacccccaaagaaagttcataatgttatatgttacaagatgttggtaaaccacacatggaggggaatgggcatacaatgtgcttttgcctttgtgtgtgcgtgtgtttgagatggagtcttgctctgtcacccaggctaaactgtagtgacatgatctcggctcactgcagcctccacctcccaggttcaagcaattctcctgcttcacccaaccgagtagctgggactacaggcgtgcaccaccatgccaggctaatttttgtatttttagtagagacgaggttttgccatgttggtcaggctggtctcgaactcctgacctcaggtgatccacctgcctcaccttcccaaagtgctggggttgcatgtgccaaccactgtgcctatcccacaacgtgcttttgagcaacagcaataactccagacaaaatgagacccagagaaggttaattgtgaatcaccctttagacacagcactgaaggaagggttgtggtgtaagtagatacctagaatgggatgcatattgcctgaaaagataatttctggaaatgatgagactgggataaggccaaggggactcacctggccaaaatacaaatagagtgtttcatacgttacttttgcggggaggtaaagaccagagaatgagtgtcaaggcacttattttttgagaaatgatgaaagatgaacagcttttgggagcatgttaaaacagatttcatctgggaatttcattttgcacaaaggaatcctgtttgagcataagcgattggtaagttcattgttgttatagcccttggttatgctaaatacgttagtagctgaaagtttccaggacttgacaaatcagataaatcatggagtttttcttttctagtttttacctgattttggatgttaatttgttgttcattgacagtgggattttcatgcaaatgttgggtgttctgtaagcctgagaagtctcttggtgtcttagcctcaagatagcagagactttactggttattgttatttgttctttccaaaatgtttccgcagatcatatttttaaataaattgtaaaaccagtgatttgtaaaaatgccaggtcagtctgacactgcaacctaaatcttcagtatttataaggtgatgtgtacctataggaatattttttttgcccaatcttaattaaatgcaaggggaacaattagaaaggcccatatagggaggaaataagaggtccaattcttggttgtcagacgttgcctctgtgttttcttattgagtatatttgaggtttacaatgtgatgttatgggatacatatagtaaggtggttataatagagacacagattaacatattgtcacagagttacatttttgtgacgagagtagttgaaatcttcttatttaacaaaaattgctgatagaattttattaactttagtcctcacgctgtactcaatgttgcctcttttgttgtgttttatattctgtgaccatacgttttgtaacattaatcatcatccaaagactacactgcagaaggaattgtttacttggacattagtctacatatgcaaaatcaggcagatatttgtacttctgtatctttgaattatatgtaatgtcaattgctagatttttaaaaatataagcctgataatactataaataattataaattaaactacatttctgaaagctaactcttcaagtgataggattgttctttgcatacctatttgtatcctgaggaatcttgcatttccaaaatatatatatattagttagaagtgatgttttccacagagttcttttttgcattgttatattgatttttttttttttttgagatgtagtcttgtttcattgcccaggatggagtgcagtggtgctatctcggcccactgcaacctctgcctctcagattcaagcgattctcatgcctcagcctcccaagtagctgggactataggtgtgaaccaccacacctggtaaatttttgttttgttttgtttttttttagtagaaatggagttttgctatttggccgggctggtctcgaatttctgacctctggtgatccaccccccttggccttccaaagtgctggtgtgacccaccgtgcccagcctatatggaaatattttaattgcctgtaaacacactcagtggagctcgttacaagaagactgtcgatgtacttgaaaagtttacttctgcataatgctaaataccatgtcagaaatcacagaatcctacgaagttgaatttttcattaaaggatcataagtaaagtttggggggaaagtgtgcagttcaatagatctcaatatgaaatggcatattattgttatttatatgtatatttaatattatataaaacacttttgttttaacttaagcatttggattctgattctttgaggcgtgattatggttttgtcattcacagcttagctatgtcatctcagataaattaatgaaatgtccaagcctcagctttggcagtttttaagtgggagtaatagtattaatacccacctgacaagattaccctgtagacggaacaagataatgtaaaatgatgaatgaaaggctttacatacagcaagtgcttaataaatgacagctcattatcattattgtttttatatttacttttttttggttgaaaatattaatcttctgaactacccttaccagtgccaaaacaaccgtaaagaaacaatcgtgcagtcctgttatccacgtggcatgagttacagggttcattatactgaagacaataaaaaccaaaaagaaagcagcacctaggaaggagctatttgcagaagtctcactcaaaagagttcaaaatgagagttccaaacctaataaagataacacgtttgccctctggtggacattcattttgagttagaattttctctgctaagactagagatttttcaacctccctaaaatgtcagggtgttgtagctggagtagcaaacagttctgcctgcttcgtttgaattttgtctgataaatgtgcaggtgaacgtctaaacgcacaacatgcatgggcaaatgaaatgttttatggctacagcgtaatgctctcctcatttttgttcagctccttcaggagttaacaattgctaagggttatttacaagaaatctgagctgtctgatcactcaactgtggaaggtaaatgagatttttaaggtgaagggaaaaggagaggcaaatggtaaaatgggccaatgcatgaaaaagagggagacgtcaaacttaggtactggaattgccgggatgttgtcatcaacgatttgatttgatgggaaagggatgcttaatgtttcttctgtgaggtgtgtgcctgtaccacacacatgtacacatacagtggagtggaaagtattcctgcaaagggccgcaattctcagagtgtagtcttttctcttcctactcgaattggtaaaaataaataatcaagactgttttggtggcttctggttccccaagtagaaagcatcttagttggcaattcagtcactgaccttgaaataggacaccagacctattgctaaaacgtcttccacctcacaggccttccctgcctgctgtcctggtgaacttgttgactctatgcacataaggactctctggggtccaaatgacggggaccaagctcgcacacatcattcagcgaataggctggctcagctaaccaaaggttccatgggctcatctagcttaaggtggctgtattccttggggcggggttgggggggaatgaaaataaggtcatcaaggtgtctctctctttctctctgactctctatttctctctccttctccctccttccatcacatatctctgttttctttttccatgttggtttcattctcaggtagacagtcttcgtgtggtgacaagggtgacctgagactccaaacctctgtcttcatcactgcctttgttttcaggaaaaggagagactcttactctgagcataacgccggtccctgaataaggacagcatctctctgtctgtatcataagcccactttcacaccagttacctctttggtgggagtgggttactctgaagagcctcagtcatgtgcccagccccgtggggtttttgttttgttttgttttttttgagatggagtctcactctgttgcccaggatggagtgcagtgcctccatttcggctcactgcaacctccacctcccgggttcaagcaattcttccgcctcagcctcccaagtagctgggactacaggcctgtaccaccacacctagctaattttttttatttttaatagagtcggggtttcactatattggctaggctggtctcaaactcctgacctcatgttctgcctgcctcagcctcccaaagtactgggattacaggcataagccatcctgccctgccttgcctgtgttttgggagtcaaggcgagatgatgagaagggagggtatttgctgacgaatagtggcgttgtgttgctaaaagaagggcaaagggtgttggatgggaagagccgaaacacgcatgcgtgatgttcagggcccttagtccttgttctttttgtctctgcaagtttgccgaagttgctctttgataatctttcttacctttccaaattgcacctaccctttgacgtatagctcaagttgtactttctctgtggactttttctcccagcctggcttcagcttgccttcgattttaagctgagagcacttacctggtgtacccactggctgtttaagtgctaacggtagctcctgctgttattgttatctcttattccagccttctaacattttttccactgtttcattttgttttttgtttaacggttttattactctttgttttggggactgacaaatttttggatgcccatcttatctaacacagtcagtactgcctcttttgatgatagtgagataggaatttcaggagaccaaaagaaagagcttgctcaaatattataacttgccctttagtcacttttaaaatgcaatgtccaaccaaccttttagttcttaatggaactcttgtcagcaatctgcttgaaggtcagcctcatcattcttggatgtggtcctggggcctcagagtgggcattgttcccttagggagtggaggccagaagatgtagggtgccccatagcaggcatctaaggctttgggtgctccaagcactgctccgggatggggtcaaggaggagaagttgcttgtccttttaaaaatttttgcctatgctgcaaagattatgggtcaaagtgaaggtcatttataaactccacccatggcaaaatccaattataaactttaaccttagtgaaatgtcattagagcttggcttggctttatttgggatggagactgacagttttgtctgtgatatattcagggagacatatctattaaagctagtctaacaatgggggcacacgcagatttgcattttaattcgttttccctcagtgctgatatgcggcttatctttcaagaacaggctcacatcaaccctgatatacgttgcttaagaataatgctcataatctattagtttaatctgttcacatgagaaagaaagaagaaatcgtgcatggtgcggagggtttcaggccccagtgggcgattttttggaggatttcccattacaactgttttcaacttgtgcttgttttcctttctctagcttaagtatgaacagcttaaggagaggtcatgtcttccttctacgtagagccaggcaagctcacattacagtcaggctcccaaagatgttggttatatgcagacttctgaacttgggttccagtttcatgatctgcaatgagcctatagcaattcaaccttgaaaatgggttttgatcattaccgattatgtataaaaatgacccatcagaggacccgtcagataacagataatcaatatttttatttttctggaagtaagatcgctgctaagacctttagaactttctgatacctgcaatactttgtgctttttctctcacctctgccactcctgggggagggaaggggtcttttctttgcaaagtgtgtttaatattggaaggagttgtgtttaactctaagagttctatctcactttgcccagtgttctgcattttcactggttctttcacttttttactttttttttttttaaacactctcccagtggattctctctggggtccagtgaccttgatgtttttcgtccagggaagatggctgaggcatcccagcagggagtcaggagtaggaagaaggtctctgtaacagagaagttttggaattgccgtggggtgctacagcatgaatttagagttgggcaaaagtgcctgaaaagcaggccttctcatttcataatgagcgtcatataaaccatgtttatcacttcgtttagccacattcggatttgtagaaaaatggatagaagggatgactccaggcagattagcaaggggattgcattgatcttggggtcattggagtaaagcaaaacatgatcactgacctttagctctagggtcattgacttggtagatggaacttgaaagcaagagtagaactcggcaaatgtggaagttaaagataaaatgtggcctggagagtctaatggaccactaaggattaatgcactttgttatcacgttggggaaagacgagaaggagtggagagaaaagaaaatttcgggatttgaattcttatacatggaagagttcagagaggttatgtccctagaaggctgagatagagaaggaggtttctgatgaaaaaaaaagcttcagccaaattaaatttaaaggagttaattgaacaatgaacgattcctgaatcaggcagcccccagaatcagggcagattcagagagactccagcacagccacgtggtggaagatgtatagacaaaaaaagggaaatgaggtacagaaattagaagtgaggtacagaactgagctagattggttacagctccgcgtttgcctaatttgaacatagtttcaacactcagcagtgtatgagtgattgaggtgcagccactaggattggccaagactcagttgttgttacaggcacatgctcctaagttaggttttcttatttatttatttaggtggagtctccctctatcacccaggctggagtgcagtggtgcaatctcagctcactgcaacctctgccacctgggttcaagtgattctctggcctcagcctcccaagtagctgggattacaggcatgcgccaccacacctgactagtttttgtatttttttttagtagatagggtgttttaccatgttggccaggctggtctcaaatgcctgaccttaagcgatccacccacttcggcctcccaaagtgctagattacaggcatgatcttatcgacctattaagttaggttgcggtttgtccacaaggactcaaatatagaagtggggagtccttctcaggccacatttagtttgctttaacacagctgaattatatgtgtgaggctatggcatgaggaagggtatcatgaagaggttgaagtccatgaggtaatgagagactatgaaagccgtgttcatgtccagtatttgccatttgcttgtttgttttcttacccgctgggttccactgtagtgttaagtcctacgagaccctggtctgtcctgctctctgctctttttccaatgcctttgacagttcttagcatgtaatcaatctgcagtaaacagctgctgaatgagggaattaataaagtcaccaaggaattgtgggctcctcttctgctctgagccccgtggatgcattgttatgcgtaataagtgtgaaatgagcatttgttgattgtattccatgtcaaagcaaaaaataaaaataaaataaatgtcagaatacactcatggtgctattaattatgatgtagagctttttttcaaacttttattttaggctcaggggtgcataagcagtttttttatttaggtaaacccgtgtcacgggggtttgttgtacaaattatttcatcacccaagtactaagcttagtacccaatagctatttttctgcttctctccctcctcccaccctctatcctcaagcaggccccactgtctcttgtttccttatctgtgtccctgtgttctctttagtaccgtttattagtgagaacatgcggtatttggttttctgttcctgccttagtttgctaaatataatggcctccagctccatccaggtctctgcaaaggacatgatgtctttcttttttgtagttgcatagtattccatggtatatatgtaccacattttctgtatcttgtctgtgattgatgggcatttaggttgatgccatgtctttgctattgtgaatagtgctgcagtgaacatttgcatgcatgtgtctttatgatagaatgatttaaattcttctgggtatatacccagtgatgggatcgctagatcaaatggtagttctgtttttaggtagagcttgtcaggatctcttcttccctctctccttctttgtctatatatgcaggtataacaggtaaaacatatgtgggatgattctacatattttgtaaatattttccatgtcaacatatcaatctataacaccaatttcaaggttttgtagtccagccgcaccacaacaggttttcatgcatcccctattgttgagcatttaggttgttctcaattctttccactttcaatgcataaggagttcaagactcgatttagagaatgcctcaaaggtagcctttggccaaatctagaactagagctcaacagtgccacagcctaaaagatgaaatttagacacattcctggagtttggtgggatatttggctcattggcttgttggaccagcagttagatttggagtggttctgcaaatgtcttgccatgaacatatgatataatgcttagagggttaaaaagcatacctggattttcaagggttaaaagtagacctggattttaggtcccagcctggcctagagcataagtgacttgtggacatcctgaaaaagaaacccattctttggaatagcagaaaagcggcatacatcttcagatgaatagtaagagtgattgtgaaccaaagggtctgggtgacttggctgtttttatcttatttttattttatttatttatttatttattcttttaagacagagtctcgctctgtcacccaggttggagtgcagtggcatgatttccgctcactgtgacctctgcctcctgggttcaagtgattgtcctgcctcagcctcctgagtagctgggattacaggtgcatgcctccacgcttgggtaattttttgtatttttagtagagatggggtttcactgtgttaggcaggatagtctcgatctcctgacctcatgatatgcctgcctctgcctcccaaagtgctggtattacaggcatgagccaccgagcccagctagctgtttttttatcattggtcaaggatgtcacactgcatggtggtggacaaaccagtgctgagaatgaggccttgcagccaagtgtgtcactttgcagcctgtgagctaagatgtcacttgcaatcgtgtagggagagtgggccccggacagcggggagatacaacgtcctcatcttctgcaagttgctctggtgggaaagaagggaaagcaggaatgagtaagggaaacagaggaaactgagctctgaagcccaacctctgcttcatctctcgtttacagttccatccctgtgagcaaacccttggtgtctggagagcagaaccatcacttcccatcttccttggctgtcaaccaaaaattgcccctgtggccccctgtagtgcccctcaacttcatgtcctacagtagaaagtcctctgtaagctcttcaggatgcacagtctagaataatggatgtgatgcagcctcagtggtggacttcctgagttcaagttctgtccctctggattattcaatgtagaaacttcatcacattgtttaaccttcctagatgtgtttgctattcttcacaatcaggatcacacatatagagtacatcacaaacaatgtaagctgcaggacagaagggttttgtgttttccaatgctgcatttatttttttattgctgctataacagattactgcagacttggtggatacaacaacacagatttattcttttacagtttgagtggtcagaactcgacactagtctcacagtgcgggcagagctgcactcctttctggaggctgatgtggagaatcttagccttttccagcttcctgaggcatcctgcagaccttagctcatggcccctttctccatcttcgaagccagggatgtagcccttctccatgcatttctttgatagtaacagcaagaaaaggttctcagattttaaggactgatacgatgatattaggcccacctggataattaagactaatttttcccatttcaagatccttaacttagtctcatctgcaaagtccctttgccatgtacggtaacatagtcacaggttcccaggattacagcggcgtggacacttctgaggggtggggtaggcattgttctgtgtactatgactgccaacacccagaatagtgcttgacaggaaaacagatctcaaatatttgccataggaattaacggtgattattgaagagatccaatgtctttaaagtgcctagtgggatacctggcacatgggtgagaccttggttagtgttacgtgttatttgcagtcatatgcatcactcaaaggaaaatttacaaacacacatgtgtgcatgtgcacacatagacacacacacactccactcaccagtggatattgtttctagatgcttactccctgtctacccaaatcgattgttcctgctgcaggggcaggagacaaagctattgaattgtatggagtggacactgaccactccctttttttttttttttttttttttgagatagagtctcattctgtcactcaggctggagtgcagtggcacaatgtcagctcactgcaacctctgcctctcgggttcaagtgattctcccgcctgaacctccagagtagctggggctataggcgtatggcaccatgcccagctaatttttatattttcagtagagatgggtttttgccatgttggccaggctggtcttgaactcctggcctgaagtgatctgcctgccttggcctcccaaagtgctgttttgtttgtttgtttgtttgttttttttactaattatgagtcagaggaaagagctgtcccttttgaagtcattaaagttacagagtccttcacagtgatctcgaaaccttggagaactttgaaaataacccaaattctcaactctgtagtagcagactcccaagacactgcatatacttttttattcccttgagttcatcaccctgtggttgagaggcaacttaacaggttactggagctgtctgacttggtttgcacttctatgagtcggcgtcatgttgggtacactttgcctttattcctcgaatttgctggttttttggtttcagactgagtggtggagaggaggcaagatcaatacctcattgtcctcactgttgcgctgtcatcagaaagcaaagtgtgtgtctcctgttgagaatacaaaagttagggccgggcacggtggctcatgcctgtcatctgaacactttgggaggccaaggagggcagatcacctgaggccaggagttcaagactagcctggccaacatggcaaaaccccgtctttactaaaaatacaaaagttagctgggcatggaggtgcgtgcctgtagtcccaactattggggaggctgaggcacaagagtcgcttgaacccaggaggtggaggcttcagtgagctgtgatcatgccactgcactccagcctgggtgacagagtgagagcctatctccaaaaaataaaaataaaaataaaaaaataaagaaaagaaaaatataaaagttaggatatcagcacaagaacttcagtgttgtagatctgctctgattcttcattcttttcaagacatgatttggatgttctgcacctacgtctcatgctggatggtgaacttcagtgcatatgctaggatttgtgctccttttgcatcctgtggctaaaagttcaggctgatcagctaagctttctctatgtgccaatctaaggatgcctttgagaatagttgggaggtcatttgacaccctttccaatagtctactgcttaaaaggaaggctctggtggcagatggccagagctaagctcctgtatccactgctcactagctgtgtgaccttgagcaaggtgcttaagtcatctctcttcctcagtttctttaaccatagtgtggtaatagaaaccatacgtatctcccagagttgttataaagataaaatgagttatcacagtgtaagcacttagaactatatctcatatacatagtaaatgcttgttaaaggcttactgtgagtccgtgactacagcttatattcatattcataagcaaatagcaaagcaatagaacctgactatgaaaaaaggtagccatgagggaaagaaaaaggatggtctcctttggataaacattttccgtaatacgtccctaggaacacattgtccacaaaagatgttaataggagtgctgagttacagggtaccacagtcataaatatttgggaaatttcttctcctggagatttatgatgcgcattagtatgttaacattacacgttctgctagagctcagagtagagacactaattttggctttatttaatccagttggtcccagatgtgtttgaccacccggtttttctgtaggtcgggggggtgggggcgagaggatgggcttagaggtggttgtaatggttgcgcttttgttgtgcatagcacctagtaatagctgtaggaactagtgtttcctctcaagggcacgctgtaggatagtactagaatttaaagtgcatatagggatctgagtaaaatatagatttggattcagtctggcatggggcctgagatcctggatttctaagtggttccccattggtgccgctgctgctggttgtactggtctgtggactgcactttgagtagccagactttcgggagcagtctcttggtgataagaagaggacccacacggggacaatcagaaatgttagcaattgtgcagtaaggagagaggagagcctgaggcagaggtttgcaaccttgactgcctgttagaagcacctgggagaattcagaaagctgctgtttggactccacccccagatatgttaacttcaaaggtttggagatgagtcctaggtattggtatttctttttcccacaagctttccaggggaggctaatggaccaccaggctgcaaaactattggtttcatagtgatgggcttaatttcttaagtcagagagcctgtttctaatcccagccctaaattactacacatcattagtaatttatttattttttatttgagacctagtcttgctctgtcacccacgttggagtgcagtggtgtgatcttggctcacttgcaacctcggcctccccagttcaagtaattctcctgcctcagcctcccgagtagctgggattacaggtgcccaccgccatgcctgaccaaatttttttttttttttttttttttttagtagatatggggtttcgccatgttggccaggctggtctcaaactcctgacctcaggtcatccgcccgcctcagcctcccaaagtgctgggattacaggcatgagctactgtgcccagcctcaggattgaggaatttagttaaagttgctgtgcctcctttcttctcattgtaagaggaggcaatcagggtacttaaacttcaaagagtcttgatggagatttgatgataccatgtttgcatcccaaaagactggtgtctaacacatggtaagggtgcagtaaatgtcagttgtaataacaattattgttatgagtattattgttattatttgctaacaaccattcttaggtcatttttttttttcttttccaatctgaccaagatattgtattggttacaagctaaaaccagataaacatgtatttaattttcttaataagtggagaattgtgttaaatgtcttttgggtacatgtgtccttactgggggagtgcttgcttctagcctaagttgcctccagcaagcattcatggaggctgtgattgccgtgagaacaggtcaaaaactgtttttgtttactgtgacaaccccagtgcctggacatagtggttcaacctgtcttggttgttggcgttgaataaatggatggtaaccattccaagtggagatatgtcagctcctgtctgcatccattcatttatttcagcaactgaaaacaacgtaatagtcatttaaaaaactgaggaataccatattttggattatttgttgttccggtgattttgccaagtgtggatttcctttgctaattatggaagtagacaaccaaatctcatttcttgtttgttttttttttttttttcctttctagaagcagctgtgttccttgccctctgccaccatcccactcatacactgtctaaaataaatagctttttctttttctgccctgtcttgtttctttctccctttgccctccacccaatttcctcttcccagtgaagtctgtaataatgtatcagtttacttaatgcaattcccagccctagctttcattgatttttttcttatttgactattggcttatgatttgtggggtagaggaggtggtgtgcatatcatgtgaatggaaaggcttaataattttcatactgtttcataacaaatatatattgtattcaggttcagtgactgcctttatagaatcatgtcagaaagtggatttctatcctgtttcatcttctatgaaaaacggaaaacaagaccttttcccctcactgtcatcccagcaagatataaagatgctcaaatgaacatttgtggaaggacttgacaggtgcccttggaaaggaagcaggattttactcactgatattttgaatatcatgagagttagaattacgaatgagtacacccaagcacgcagtcggttaaggagactttcatactcattgtggacactgctcacaggcaaaattgattgtgcggctccagttgctagagccacggggatttgagaccacagctacatccatctaattcaggaagaacttgaaatagctcctgcattttcagtgggggtaaaaaaaaaaaaaaagagccttttcacatttatcctgaagatggagccatttaacattttggatactttctgatttttaaatttataactttaaattgactttgttttgagacattagtgtttcaggattttatttttccctaaaatatgattgcttcctaaccaacagaaggaagagtagtgtgaatatttggttatggtcatggacacctggggaccagcctgtgtccttgcccatatttccaaaggtcactcttttttttttttttttttttttttttggagacagagtgttgctctattccccaggctggagtacagtggtgagatctcggttcactgcaacctctgtctcccaggttcaagtgattctcctgcctcagcctcccaagtagctgggattacaggcacgcgccaccatgcctaactttttggtatttttagtatagatggggttttgccatgttgaccaggctggactcaaactcctgacctcgtgatctgcccacctcagcctcccaaagtgctgggataaggtcactctttcttgtttacctgtttctgcccatatctgtagactcagaaattatttactaagcatttctaaaatgtgtttagaattcccatcactgatggcttactatgaaggagagcatatttttaaagccatataaaagaaggaatgtgtttagttctgttactcttgtattaatcccttggttattgaatctagaatctttgagcccggatgatcctagagggtatctagtctaccttctcatctcgttcttcaagacttgtatttatgtagctagttgtcatggctggattaaaatatctgtgtttacttatgtaactctcaaaactcactttaattgatctttttagcaagggcctgtttttcacttgcaaatgaaggtgaagtaaatacagattggcattttctgtcctaaacagccaccagctcccatagctgaatactctcatataaggaagacaaaagcaacaacaaattaggggccaaaattccttacttagaagatgagttgtctcaattgggaaggatttaaaaaatatttgtataccactcaacaagccatctggagaccatcatgggctgaactcaggtgagacatcttgataaggtactggaagaacagctgtcttaccacagggagggtggatgtggaaagaaatctagaaacccaaatataacaaggagcccttaaagcagttgtgggcaactcctgcatgcttgagatgagcagtggagacgacagtggggctgtcttctccctttaactatccaacgccgagggtcccaggctctgtgatgatgatgtaggcaatttcttaagaacaagtattgtttttggtagctttactttctagaaggctggatctcagttctctctcccatatcacctgtgtccgcaggtggggagattgatgtttagagctaggtttatctgtataaaggaataattctgatcgtagaaaaactcgaagtactggagacctgaccccatgttgggactctctgatgccttgaacatagatcatcttctgggggctgggctgtagcatcaccctcatctcacagtctgaagtcctggcttggagccctactgggctcagagactgtggtccgcagcccactagtgttatcaatcccatcagcatggatgcctacagcaacaagaaccagaacacccaacagcacctgctgctgcctctccttctcctcttctttccccaccctttcctattattattgttgttattgttaatatttatacatctattggtataaggaaaattaggccaaaacttagtgtatcaagatcaaaacacattatctttcatagtttctgtgggttgagaatttgggagcagcgtagttgggtttcaccatttagtgtgataccagctgtagtattttgtagatgccctttataaagttaaggaagttctttctattcctcggttgtgagggtgtattttgtcatgaaagggtcttgacttttgtcaaattctttttctgcatctgttgagatgatcatatggtgtatgtcagggtttaaagttttttccatgtgtggctgcatttggtttgccagtatcttcttgaagatgtttgcatctatatttataaaatatgtagatctgcagtattctttccttttgattttttgtctggttttgatatgaggataacagtagtctcagatttcttcctcttctattcttttggaaggtatttcgaggtgttagtaataattcttctttgaaattttggtaaaattcaccagtagaggcactggggtctgggtttttctttatgtgaagttttttttgcctactaattcattctctttgcttggtataggcttattcagattttctatttcctcttgaaattttggtagtttgtgtctttccagaaatatttttttcattttatctaggttatctattatttttggcctaaaattgtccataagatacccttataatcctttctattctataaaattggtagtaatgtcccctctttaatttctgattttggtaatttgagttttctttttttttttcttggtcattctcgtctctctgtttcatttttgttgttattgtcattcttcttttttcttttttgagatggagtttcgctttgtcacccaggctggagtgcagtgttacgatctcggctcactgcaatctccacctcctgggttcaagtgattctcctgcctcagcctcctgagtagctgggattacaggcacccgccaccacacccagctaatttttgtgtttttagtagagatggggtttcaccgggttggccaggctggtctcgaactcctgacctcaagtaatctacctgcctcggcctcccaacatgctgggattacaggtgtgagccactgcacctggcctcttttgtttttaatcttcatttctgaaagtttttatattatctatatagcttaaagaccagccaaaaatcagctaagattgtgttcagacaccttgagcactaagaagtctcctgtcctctactgatgggtttgtgtgtatgtggaggtgtgcattgaaatttcaggccattttcaaatctttccaagtatttagactctactggttcctttggtatcacctctgcatctgcacactgcttcaggattaatctgaaatgtatgggctggtaaagtcattggctctctccagttttccatcactgagaatataatcacttctaccaataatgctgctggatatggtcacggccttctacctgaaaacacatgagctccttttggaccatggcaactgagctgccagtactcatagcctactctacccaggcagagcctttgtgttaactagggatgaagccctcatctagaataccaaagagtcccactgttcttgcctaaactccagtcgatttttggtgaatacttgttacattattggaattctttggttgatttttagagtgctgaaattttgggggggtcagttttgtccacaaggattattgctatttggagagaggaatgtctgacttcctcactcagccatagctggtagtcccaaatatttttcacgtgaacttgcatcctattagccaggaaagggcacaacgcattgggaaaacttgttttaaaacagtaaccgtagtctattcctgtggtgggggggaggagggtccccacatattcacattagaagtcttacgtgaagccattggggattttcctcaaactttacccacagcactatggttctacaggataagatcctgtcatctattagtgggtatggagaacattatgtgcatgcagttgacccacaaaatctcagtgatgccgtataattaagatgtatttcttcctttcatcatggtctgatgtgaattgggtctctctctggttgtaggttccttccagccgtggcaatatcatcttgcaacattttggctcagtttccatcgatggggatgccgagatcattggcaattacggaggatgtttccagaaagcattttatatcatttctgatcatactgtattagccagagttcagtcacatggtcccactaaaatacaaggaagactgggaaatgtagtattcctgtgtgcccagggaaaatacaaaagcaaacatttggtgaatatagtgcattctgtttgccactcattctttggagatcctatcacattattaagcttattctctgggaaagaaaattgggatgcagaaatcgtgaatgacttaagatgtgttgttttaagtaagttactggaagattaggaactggaaatatttattggcttctaatttagttttttcccccaattttactctgttctctctcactttcataaagtgttgcttcttaattgacataaataatacgacctaccacagccactttagaataagaatcattcctaattccaccagtttaagattaatgtatgcatgttttctttacagatgtacgtttatataatcaaacagctaatatgcatttgttttttattgtgtttgccaacacgcacatagtcttcatatgtctacattcttattgtaattactatttttattgccacataactttgtattgaattggtctaatatttacttaccccttcctcctattattagacatatagttgtttcaattcattttaacctatataacacattgtgattttaaatatgttttaaaatatatttttgcaacaaatgctgattaaattgcatattctgaccacctgtggacatttaggaacgctgtagttaaatagggtacctctaacttacatcctttatgctcttactgaaacatatgtgaatatagtatagtactatttttacataattcttttttaatgaaaatatttagcttgtgaagaatagaacacattctcaagagttgaatgaacctgttaatgtacttttatcagctttgtaatgcagtatttcattaaaatgtgtttatactaatttagtagtatggggcgaaggatgaaaagaaacccagaaatgtcagatcatatacattaattcactgacaaatgtttttgagtgtttactaagttccaggcagtcttttagaaactaaatatatagcatgaagaaaaatctttctctcaggaaatttgtgttctattgggtgtcaggtggcatgtgaggatacaatgtttgtattaaaaacaatgtattaatcgccatgaagaagaataataaaggtaaggagggctgggttcaatggcctacacctgtaatcccagcactttgggaggccaaggcgggcagatcaggaggtcaggagatcgagaccatcctgggtaacaaggtgaaaccctgtctctactaaaaatacaaaaaattagccaggtgcggtgccatactcctgtaatcccagctactctggaggctgaggcaggataatagcttgaactcgggaggtggaggttgcagtgagccgagatcgcgccattgtgctccagtctgggtgacagagcaaggctccatctaaaaaaattaaataaataaataaataaataaataaataaataaataaatgtaaggagaataggatatgttcgattgggtaagggatgctgttatatatgagagaggggtctgggaatacatctctgatgtgtaacatttgtgcagaaacatggaggtggtgaggaaaagattcacgtggatgtctagaagatcagaaagaaggaacggccggtgtaaagacacctggctgcagacttcttgtcatatccacagcaaggagtttagtgtggctggagcctggggtaggggagaaaaagagacaagagtggtaccacatgaggtgagtgttagctggggtagaagctaggaggggactggagcatgtagggctttgaaggtcatagtatggacctgggatttagctttgagcaggaaaagaagccattggaggatgtattagtccattttcacactgctggtaaagacatacctgagagtgggtcatttataaagaaaaaagtggtttaatggacttccagttccacatggctggggagaccgcacaatcgtgccagaaggcaaaaggcatgttttacatggtggcaggcaagagaaagagacaaaggaaagggatttccccttataaaaccatcctatctcatgagagttattcactaccatgaaaacagtatgggggaaactgcccccatgattcagttacctcccatccggcttctcccataacatatgggaattatgggaactacagttcaagatgagatttgggtggggacacagccaaaccatatcagaggatgttgagcacatgagcaacatgacatcatgcccatttaaaataaatactctggctgctgggtggagaataggtgtgggaaaggatggaaccagggaatccagaaggagacattacactcatgggggtgagaagtcgtggtaaatggaacagaacttgcaggtgtgagaagtggtcagagtttggatatatttccaaagcaaagactatatgatcgtatgcttaggtaatggtttgaacgtgagatgtgaaagagagagaggggtcagtgtttactatgggaatttttattattcttattattttagacagagtctcgctcttttgcccaggctggagtgcagtggtgcgatctcagttcactgcaacctccgcctcccgggttcaagcaattctcctgcctcaccgtctcgagtagctgggattacaggtggctgccaccatgcctggctcattttttttttttttgtatttttagtagagacggggtttcgccatgttggccaggatggccttgatctcttgacctcgtgatccacccgcctcagccttccaaagtgctgggattataggcatgagccaccgcttctggtctactacaggaatttaagcttgagcattcagaaaattgaagtgctagttccaagatggattgcaagagaagcagctgttcagggaaagagagagagaagaaggaagaggaattgcaggtttacacttgtgtgaattcggcatgaggtgcccattggatttccaaggagagatgtcaaggagacagctctgtgcgtctgtagaacaaggaagaggtttgatatggagatatagatttaggactttccttcttatggatggcattagacacctttagacaggaccagctcacatccttcaccatgtgcacaggctctaatatattcaacatttaaaaaaattaccctgtgactctatttcctctccatctgtcactctctttctctgatttcctttacaaaactctgaaataaaacttgtctatatttgctataatttcttttccttccattctctcttgaattcattccaacaaggcttccctcctgcccaccttcgaggtgatcttatcctgtttcaaggcgttcaataccgacaataagctgattatctccattttacaatgaagaaaccgaagttcagaggggttaaagccacttgagtattcaatagcagaactcaaaccagagccttgctttcctttcctatccccagcctgtctctttccactgcatccttgttcacgatgaaatcgtgtttgcaaacaagggcttggaaggtgatcagcgtgggtttaagtaccaatgtacacagagcatttaaaaaattcctcatagctaaatagaatataatatttcacccctatacacttgtgggtctaaattgttaatgtctgttttcttacaagaaataaaacttggagaaagactgtggacttgttccttaaaacactataatttcatgtaaatcattaaattttttaaaagtctgtgataatgacatggttgatgagcgtgagagtaggagacaggaggagagttggatcttctttccttgacatcctaaagaagaaggaagacaggaacctttcagagcatagcaacagggtgtgttaccctccttagagctaaggacaggcagacccacatcttctttcttacctaaatagctatgacttaaagtcaatcttgtactgctgtggcattattatttctctattctccttggatgtgtgtttcttgcaacggaagtaggaggattgtccagaggatttgaaaaatatttttttctgacatgattatatctgtatatgaattcatttttttggctgtgatctgtaaactcaacaaaacaatgccaaaaaaatcaaatgtggtgaagtgctttttttaactcctgggttcgtcatcatcagtctaaaactcagtcatttatagactgattcatgaagaaatatacaactgatgactctgggttagagtgttgttccaggggatgatttttctgtgcaagggaatttggagtgagtttgaagaaggagaggttatgaattagtaaagataaatagagaggatcatctgcatatggggaatgttccatgccgaggtgtgagcacaagaatgaatacattgttcataagggtctgtaaagatacttgcttggttagagagtagactgcagaaacagataactaagaatggagatggatatagtgaggagaggggcggggaggagtgtgaggtcagggaaaagaactggacattgccctagcttcacgttgaaagcagagatagggagagtgtggcttggtgtggaccatgccataggctgtatttggatggattatgggttagtgtgaggaaagactgaagtcaggaaacaagatggaagctccatagcaatgggcatgtctggagatgacgttgaccttgcctctaggaggggagcagtgaacatggcaacattggtgccaatggggagtgaaaaggagatggaagaagaggtcaatcctccatgtgggcagtattgggcatagcagaatatgcagagaatgtagggtcacactggtgaacaaaggcccccgagttgggagaaatctaatcttcgctcaatactctcgtggttcaagatcctcacaagtcattggatgtttctgaagctccattgatctctttatttgggtatatttatctgtgtatctagtcagtgatactgttgaactgtaatgatttgatatccatttggcatgtttttgagcatcagttatcatggaccagtagaggggatgcaacactatatcagagagacacttttatcgtagatgtatagttagaaagttattgtcatgcttggccctatcatacaaagccctgatgctttcatgggggaaacaggaaccctttggatgacctgtatcaggtcatagaaagcattctgccttctagggaagtgagttgggatgacgatcgatgttttcttggagagatgctttggtctaagccatgagaggaggaaagagtagaggagggatattttaagctaaggtgataacagcatgcacaacacccctagatgtgacgaggctgagaaactagaggaagggtcagggcagagataacagggataaaagattgggaatttaggcggaagtcagacagctcagcattttctaagcttttctaatgatggggaatttaagaattactgtaaccaaaaataactagctctcacaagtattgtgtaaggtgtctctggaaaacagattggagaagacccagctggaaccaaggatatcagttaggagattttcatattaatccaggctggagatcaggatacaggtggttccagtgggaactgagcaagtaggtagttttaatcaaaatttagaaggaaaaatgcaccttacttggtaactgcttggatttgatggcaaagtgggatgtagagagtgggagacggaggggcaggctaggataacattaacaaacgtttgccagacacccagagcaaagtcagctttcctctctggctctgatacgaatgtgaccattgttaactgtttggcacatgtgttaaccttagaatgttaccagtgttaactgttttgcacatgtgcgtgcatatgtgtgcacatgaatgtgtgtatttaatctcaactattcttattttgccatgaaattatttaacacacatgtgctgtgtgtatgtatatgtgtatacactcatccctcagtgtccacgaaggatcctcactaataccaaaattctggctttgtgggatccacgtatacaaaaagttttccctctatatttgtaagttttgcatcccatgaaaactgtatcttctatgtatgctcagttggataaaaaatccatatataagtaagcctgttcagttcaaactggcgtgatccaagggtcaatagtttacgtctacccacacattaactagtggctgtttcaaggaggcagactgagtgatttattttcatgcttccttcaattttttctaagtttttaccatgagaaaaaaaaaaattttctccagaagaccaagaaacaattagagctttgagaagaaatttatctgctgttattgattttgttttagccaaaaaaaaaaaaaaaaaaaggctaaacataaaatacagtgttcgtaaacctggctggcaacctttctctgatgttattgtctatttcagacaacgcaaagaggtgtatgaaaccagaaaccttcagctatgaggaaaacaaaataacaatcaatatattttgtttctgcttacattttctgctaactccttgtttcccagctaccagagagctgtcaacttcaggaattaaattaaaaagtataaagctgtgaatgaaaaaatcttggaagtaatgagactacactgaatgaagtggaggcgaaaaaatggaacacagtaaatgggcacctgtatcagtgtcatctttaaatgcaaatgaaaatgtcccaaaccttcctaccgctgatactttgaagcacatacagttcatttttagccaggtgtatcagttttgcattgccaaaagtagtagtggactaaaacaccagtctgcttttcttttattaagagatctgtaataagagaggttgaaagaaattttgcagtgccaaatgagactccaagtgcagtgcaagatgaagctagtcaattctgaaatatttgaacatgtttatttatctaaccctctatgaacctgggcacagatgctaagtcttccatgttttatgtggtttcagatgacctctgaaaattacctgtgccattctaaaccaccaaatggttccattttccatctgttgtcatgcaattgttttgcttaccagcagctgtcagatggatattacaatgaatgctttcatagcaaatgttacaacatcaaacataacaagcattgaggatgaagctgatggcacagggagatacagagagcttaccaaaggactggaaagggggccctggagtccgcatcaggacactgagtgccattcccggagtgcattcaagagtctagtgcgcgctggttcacaggtgtctctttttgccaactcatcataaactcctcagctgttaatgcagagtcgcttgctgcaacagtgacagagaactgttgggttgccggggctaattgctatttagctctttcagaagggttaaatgcattggttagcttgctgaaggtttgggagatagcttaggtgcgggagcactcaaaccacagggacgtggctgtcccacctgctctcgttgttgggggcattttaactcatcacctgatgctattggaagtagctataaaggacagctggtggttgcatttatttggagtcttaattcacctgttgtctctctccagttgtggttgaggttagaacactctgactcctagaattcgtacattccactaaacaagtaatatatgatattttttaaaaaaattattccatggatattttctccctttctgtggtttgtcttttcacatggttaaacatatattttgttgtgtagaagctttttcacttgatgtgatcccaattgtccatgtttgctttggttgcctgtgcttgaggggtattgctaaagaaaatctttgcccagactaatgtcctggagattttccccaatgttttcttgtagtagtttcatagtttgaggtcttagattgaaatttcagtgaaagagataaacattttgtgaagttatctatgtttgtatatgtgtgaattcaggtgtgcagttttattattttttgctcaaagtggaatactattttgattagtaccctcaaaccgaaatagtatttatgaagtccttagtgcatactcctgtgcttcaaattctgtagatgttcaataagtatttaaatcaatgaatgaatgaagggcagttatttgaatgactccattttggcttcatgtcttgtttggggatgttgagttcaaagttattacatccaaaccaacactaagtagtaatgttaggatgtgtcctatagacgttgttctgtatatagtatcaacagaattatgtagtgtcaggtatgtagcatccggggtcctacagcctatgtttgaatcctggctttatgcaacagactaggcaacctggaatggaatgaactacttagttttctaatcctgtgttgattatttcagaaaattaggataataaaaggacttactccataggattgttatgaagttgaatgagaaaaatcgacttaaatctttcagcactgcctgtaacatataagcacttgatatatcgtcgatggtactattattatttgcctaacattttgcttttggggaacacacagccaccaatttcccctctcagagatgccacttgacttagtctctgttggtcccacccttaaaattattgaaccacgtgctatcaggcatattgcagcaaaatatggtgctcagaatatcatggcttatgtattttatcttgctggcaaagaattctaaaaggtttaaagcttaaattagagcccacatttaaaccgagttgggagaaatgtaccatatgcctctccatcttgtgtgtggtgtgactgtaagtgagagtgaatgacaacacgccgggggctccagccaaaacttgaggccggcagtctaaatccagatcgggcagcctcccagcctctcccgattctgtctgcttgtgcatttgaccttgacagccaaggtctgtgtggttcctctttgctttctgtcattaatcagtcctgaagcatcttctagacagacagcttggttggattgaataatgcgtctgtggtttttttttttttttttcttcatctgatacaggcatgagttaaactacagtcgcctccattgctgaacttggctattgggctgggcagtattttcaagcggtgttttacctgaaaatgttctataaatgagttctgaatgttgtcttctccctgtcatagtgcctgtgattatgataacccacccttgtaagctttctcctatagcagaaattgttgccagaggaaggggagggatggcatgtcctttcactggcaagtgaggccagattttgactttgagtcactcttgagaatttagggggtggtcacatggtactgtgcaacaggaagtgatatttatcatgataagtgatgtttaccatgccccactttacaactgccgtgtatctcaaatgttatgagtataccactgaatgcattctttattggagagaaaaaaagttagcaccgtatagagaaatatatagttgctagaactgagaaagggtaagaaaacaagagtaatctgtaatttttttgttgcatggtccaaaaggcaatttctgttgcctttttatggtgatttggagtttttaagatgttttgacttatttaacaagctggaaactcatggcagagagaatgtttatgacttaccgaaaatcttatggaagttcaccacagagctttccttggaatgcaggtatcgagacttgattttcagaattttgcactagatttcctaacagaaacctcgtgatttgaaggggggagaatcatctctgcaattatgtcactgctaagctgacatagtaaccaaggggttagtatcagccttggaattctgtaaatatgtcttgggacaaagtggtatggaactacatctagtagattgaggaagaaggtcatggaattagaacatttctgttacttctaggcataattttcaggactaaggaattcagcatgagctgcatctgcctcctgctacctcctgctctctcccctgtatcaataactattaattctgtttccttccccatcgcaatttagtttggaagatgtcagtgctatttaacgcagcgagatctccccagcacacccctcgggaccagtccttgggtgttgggagggcattctaccctattatctgtagggtggctgtgcttgttctcatgccacatcaaaattggcattggtagctcgctaatgagtaggtagagatgggcttggcattttgtcttctgaaggaacggcagataagatgaataatgtcattcttagttctagttttgtctcttcttactgtctttatttgagcccctctacctccctcatttcttcttccttccctctccattttccccttccttcctcccaacacccccatacacatgcacagctcacacaccgttttacctatctcttaactgacagctttaataaggatggtcactaagcatcttcttataatttatgatagaaaatggtatgcaaacttcagagatacggtggtggagatccaagtttatatcttgagtctaccatgtaactctcaatatgtgctctagacgctctgtgtctgtttggttatctataaatcagcaatgataattgtactgacctcataaggttgttgggatgagtcagtaagattatgcatgtgaaatgcttagcacaggttgtcatgcactaaaagatttccgtaaacattgtttattatcattaataaaaagcatctttattgagatccatctcataagatgcaacaccaaagctaatatttcataacagacaagcactctttgagtgatatattatgtcgaaattcaattaaatgtcccaactcagtgtgttggaactggtagcctgaaaaagtcccattcatctgatggctgtgaaataatgagaatgtttatctttgttccatgaagaaatgtataattaaagcagtttgtgacgtacctcccgaagattcatctctaactctgtaatacatttagtgatttcaatgcaaatgaatcgtgttggtgaggcaatgtgttcatcctatgtccttatctgttctttgaaaacctcatccaaggctctggggactctcgcagcagattgaaaatccccttgctggcaacagctgattagactgaggagagacatgcatggggctggccaatcagattatctcttcgtgggagttaagaaatttgacacagccccagtgtccatattctttacatatatatacattatatatatatatatatatacattatatatatatactatatatatatatatatatatatatatatatataaaattcagtgagaaggttagtaggaaatgaactctaggaggacaagagttggatagacattatcatttactggctaagtgacctagagcaagtcacataaccctgggaacctcggtttcatcaatggcaaagcaaagatgctaataggggctacttttaaaaaataaagaataaacacaataaaacaggcaaagcattcagtgacttgggcagcagtgagtgtgcagtaaatgctaaacattttgaattgtattcagccttcatttttcagcctgatttttaccttgattctcacattgaaactgcccatttctttgggtattttgggtcttttcctgttttaccctccccactgggtttgtcactgcacatccctccttccttttgaaagctctgttcttccttcattctcctggtaaacttgccgagtctctgcctcattgttttctggctttttgcattgcctcatcttcctgtgttcacacctaagcgaagttgctctccaaggttctgacctccgcctcttggctttccattgtgttttctcatgggtgacctaattcacacaacatgcctctaagctgatgaagcctagaatctcattcctgtatactaactgcctcttggatgtgtcttcctggaactcacacattctaagtaagtggaattccacatctggtcatcatttcataccgttccttccctcatcctctctcagttgatggccctcaggtcctcagtttagaaacttgttgttcaggctctgcagctcccccatctcaacctgaggtcctgcattacctcctgaagagccacagaatccagcatttgccttattctcactgttctttgtgaccagttcacctctcacccaggctgctgcaacgagcttctaattggcatttcttctctttccccttcaaatccctcatgcttgaaaataaaaatttggtcatgcctttcccctgtttaagtgttttcaggattatgaccaagcttagtaacgtgacttgttcctctctgctctcaggaacactccttgtttctctctttcaagaacagcctatttacagttcagtgcacgtaatgagcctgtactcatttctctgtctttatgtatgctgctccctggacccaccccattcccttctactatcttggcctgaaaatgtctacttatcttctaactctcgattcagaggcagccttcctccaggcattctttccctgagtgccactggctctttgtctcattttctgggttagggtttcttacattcatgggcactccaaatactctatccctatacatctatcttgatgcataattgtaaatactgtttatctgtccattttcaactttacgtttcgtgtaccttcccttgagggcaagagctttatgtttatctctatccttagtgattaatatggtatgtcatgtgtactaggtgcttaatatctgagtgactactagaatgaatgagtgagtagatatgaatagttttcaagatttttaggaaaccaaccctatttaacttactctgtgatgaatcttttagttcattcttttttaattcatgaagtctgcattactctaggccagtttttccttgcccccaaatctttcagatacggaatcagagaaacataagatgttagggttcacagttttgcaaaatgctgatgtaaaatacccaggagcaaacagatggcttaagaaaggtattaatcatacgacatattttcctttataaaatgccttcttacctaccgcctttttatccccattataggttttctttcatcttggcaatgtttagagtccgccatcttgccttgtaagccagtcttattatagcatttgtgctgtgcctccattttaactcttgacttttgttgctcccaccacacgttccttaaaagtcaatcaggagtttatgtatctttccgtcttctggactgagaaaaatttatggcctttagtagatgctcgttaggtttgtagaatgggccgggcgcagtggctcatgcctgtaattccaggactttgagaggccaaggcgggccaatcacctgaggtcgggatttcgagaccagcctgaccaacatggagaaaccccatgtctactaaaaatacaaaaaattagccaggcgtggtggcacgtgcctgtagtcccagctacttgggaggctgaggcaggagaatcacttgaacccgggtggtggaggttgcagtgagccgagattgcaccattgcactccagcctgggaaacaagggagaaactctgtctttaaaaaagaaaaaaaaaaaaaggtttgtagaatggatatgtgctctctctgaggtcatggggtgagcagggatgccaaaatatgcttactttgagtcacggaagcagtagccatttaagagccttcaaagggccagattgagtttatgtgatttaggaatcatgatcctaacacatctccagaaagagataaacgggcttgagaagaagcagagccatgctgggaaatagattgggtggaatttaaatagaagtctggatttgaagtaagaatcataaagactaggagtacttgtaatattcataataaaaataaatcctatgagaaccattaattaccatacacagtatgcttactatgggcctggtactgggtcaagtgctttgcattcattctcacttagtgcttcaaatagttctacaagttaggcttcattgtctcccttttcagatgcagaaactgaggcctcaaagagttaattcagccatttaaggtaacaaagctaccaggagtttgaattcaggattcctaagctcgtgctttttttacccctgcaccagaggaagttgtgtgcaggtctctgcatctgtcaagttactggatatgttattttgagcgagtgacctaacagggcttcagtttcatcatctatgaaattgacaggataacattatctttcagattttttgtaggtaatttaaataatttgcagaaaacgtttaacacattgcatgggatacagtagacaataaatctggacttttattaacgataaataattagcttcccattctgaaatatttcaatatggatgcgtggctgcgacttaaaaagccaaatccaccccccaaatgtgaattattgcctaactcggtccctgaaactggaaatagagaaataacatgcaattccagcagtatcaacattattattttcatttttttcctgatgctgtcagcttgttatttgtgctatttctttgaataatagaatttattcaggcaatttatccttaatacaagcgatataaatggggctatgcaatccttatatatcatgctaataatgtctggttcatcttttttttttttctccctgtttacatatggagacattgatttcctactccgtcctgtcttttattacattttctgcatcgaggtcatctctgtccgctgcctacactggattccagtagctgaagttgtgtaacatcattcagtgacattcttaaagcatctactatgtgctttcttcaaaaatgtgtgtattagagtggaataaaaaagaagaaagacatatataattgctgtcctcagatatatgttaaatccattagttaaaaatgtccacctagccagtgatttaaggacaaatagaaagctttatattgggaggttctgaaatagtgtcagttaaatgcatgcatgtcaccagaggctgtggatactatgcatacgtcttatttcttcttcctctgcaccctccctctggtggcccccaagcatctcttggtgactccccaaactgagatttctagttccagtgtttttctttttttttccaagcttgagactcatattttatcatccgtatctcccactgacccctggacacccttcattcgttgtgtctcaaactgaaatcaatacccctccaccccatccgcaatctgcaccatggtgaatcacatgtggtttcagcttacccatgttggggacctgcaagccaacactgggttgcttgttctatcatccctgctccacctgagcacaattaatggttaattcccatcaactaacttctctataatttcttgaactcaacctggtgcttctgtttcccgcaaagacaaaaccagataataggaacagtagaggaccaggatcacctgtttggtgcacaatgagtttctttttttttttttaatttttatttaagattcaggggttcatatgttgttttcttatatagataaagtcatgtcatggggattcgttgtacagattattgcgtcacccaggtattaagcccggtatccaataattatttttttctgctcctctccctcctcccaccctccatcctccaccctcaagtaggactcagtgtctgttgttcccttcgtgtccatgagtttccatcatttagcttccacttgtaagtgagaaaaagtggcatttggttttctgtccctgcattagtttgctaaagacgatggcctctatctacatccatgttgctgcaaaggacatgctttcatttgtggcttttctaacacattggaccaaaaggtctttaatctctttcataataatggcattgaattaactaatacttacctgacgcagataatttaacttgtctacatattcacctggtcctgtgcatttcagacttttgggggaaggatgaggggggtgacaggtgagttctcatcatttggcagccacttataagtgaaaacacaaggatgatttttatcatgcttcagacagaccttctgaggttagcgccaagacaagggtattgaatgtgcacacagaaaaagaaaagctaatttgagtagataaaaaggagaaagaatcagcaagacttgatgacaagatacattcaagggaataacacataggcaggaatgctctctaaacataatcagcatattacatgttttgtctatgactttgtgaatgaagcccacgggagaccttcttaaagaaaataaagagggagactctttttaagatgttaaaatagaggacaatgaatgcttttgcgatgagttatctctgtggaactgtgtgaccttgagcatgtcagtaacctctgtgggacttaattcatcttctgaaaacaagagattggattagataattcctaacattccatgcttttaaatagacttttatgattaggaatttggcaggtagaggggtggaagcataacatttaaaagttggtggtgattgagtcgagttagaagtgggttgaattatttttggaactaaagtgtacccttgctgaaatatagaataataatgagtctagtattaatatagcctggcttaagtataatactaatataaacaaaattatattgagggaaaatgatgtttatagagtacaccatcaagatgagctctagaaaaaggaaactaaaccttctctaaacaggtttttttttccctatcatccgcttctttttacattatcattatgttttccaggctggcagatgaatatcaaatctgcttttgactgaacattttttaaatctctctgatagaatatatatattttttcatttatgaaaagcaaataggtcacgtgttttctcttctgcagcaaagaaatatagcaaaagtttctatgctccgttccattttcttattgaaaaaaatatttaatataaatgaaaaatattcatttactttttgaacaaagtttcatcacagatctcttactcgggagtaaatactggttaaaacaagctaaatgcacattcttaataatttaaagtcagagaaccagccatgtgtaaaataggtgtatgttcacataattgactacagtattttgctacatggttaaatgcatgatttcccctaatagaatgccattgtggtctacatcacattttctagttcatgaaagtcaaatgagctgtgaccatagtctcccaaacttaatgggaagttcattttgtgacttctgagtttaaattgtgtctttccaggatgaatcagtagatctaaagcacattaatggatcacgtcaccaaaaggtctaatcctgagtgactaaaatggtagttctaattcagatttagtgcttttctagcacattggaccaaaggtctttaatctgtttaataatatattggttttgtattaactaaataatacttacctgatgcagataatttaagttgtctacatattcacctggtaccgtgcatttcaaacttctttggggagagatgagggggtagcagatgagttttatctgtgaaaaccagtaaagaagtagaactttatagacaggggctcacagtatatatttttaaaaatctgtatgggatgcttgttagcacaacaaatttacacactgctctgccaacactctcagccacagctacctatcagaaggttatgaagactagaagaaaaacacataagttatgtcctggactgtgcgaacactcatgagcacagccagaaactacagctggatgttcaccgacagccagctatccaaggtttttgaccttggacaatgagcaggggttgatggagatagccaggcctagagatggcaccatttggaagatacaaatggagatgtctagagggtgctggcagtaagcttctgcaaggaccccattggaaagggagccaaattgtttctgttatctcagggaacaccttgattctgaaagacagtgagagagcataaggctacctaagacttctggaaagatgaatacaactattaatatcagagctgcggcctcaagaacagccgggattctccctaatgacaagagggtggacggtctctctgcatccctttcctcaagccttttgttcaacgcttttcattgtatgccccgaaagagagcagttttaagcatctgcgatgtagtagggtcacctgatgtgagtgagagagagagagagagaaagagagaaatgaaatcaaatggtgtgggtgattccagttgccttcttgttagcaagagtgtataccatcagttttgcgataacacaacatatgtgttcctaaaaatcaccactctgtgtaaaatcacacaatataaaccatgggacttaaggggaaaatgggattaaaagcaccacactaaaaagtttcatcagtgacacatttaaaaaaatacagttttacacacgttaaatgattaagaaatacataaatactacaggagagataaccctttaccttgaagaagttcacaagtttgcttggggaaggacacgtctgaagggttgtgtcttgtgtgttattgtgatgggatagacaaggggacttacctgaaaccagatggtaaatggtaacaccagatgtgggtgggtatgactcaggaacacatgctgtgaattgacgtagcaggtaagtgtttgaggtgtgtgcttgtgtgtgtgtatttgtgtatttttatgcagctcatttttgctggatagagttttcggtgttaacttagtgaggtttttttttttttttaagtgaaatcgagcatgagcaaatgtgaaatccgcattatgctcaaatcgttccctagtttttttagctcccacatatgagtgagaacatgtgatatttgtctttctgtgtctggcttatttcgcttaacataatgtccctccagttccacccatgttgttgcaaatgacaggatttcattctttgtgtagctgaataatattccattgtatctatggtaccacagtggctttcttcattcctccgttagtggacatgaaggtggcttccattccttggctattgtgagcagtgctgcaatgaacatagaggtgcagacctcttctttataagggttttcttttctttgggagagagccagcagaaggattgctggatcatatggtagttttatttttagttttccgaggaacctccatactgttccccagagtggctatactaatttgcattctcaacaacagcgtataaggattcccctttctccacatcctggccagtattcattattggacttacagagatagagtggaatgatggttgccagaggctgagaagggtagcccggagtggggagagattggggatggttaatgggtgtaaaaatacagttgatagaatgaatgaggtctaatgtttggtgtcataatagggtgagtatagttaactatattttagtgtattttctaaaataactaaaagagtggaattagaatgttcctaacacaaagaaatggtaaacgcttgaggtgatggataccccagttaccttaatttgatccttacacattgcctgcctgtatcaaaacatcacatgtaccccgtacatatgtacatctattttgtgtccatgataattaaaaataaagaaaatttttaaaattgttccatactctgtcaactcatggacatacatttgcatgttcaaaacaagcattatggaattgactacaacttagagcatgagatggggcataaatattgagggtcccctaggtcaactcaggtccccattgtgaacatgtcagagtattggaagagaccacagttcccctctaccttgaatgcaaaccagccccttcatcatgtgcccaactgcattaaaaacaaaacaaaacaaacaaaaaaacataccttgagttgggagaaacacatagctatgtcagatcattaaccagtttctaacggagcaacttcctagggaagggtatgtttgaatccactggatgtttttgctttacacatttatttagagcctaattttcacatggctgtgtctctactgttctcttatctcaggtatcgatgccctgagataacttcattccaacaatcaaaacttgtctaggaagacctgattgctctgagagatttgccttgtgatttgatcatttcttgccatccccattgactggcgatcttcatggcagctttaaaggtgctttgaggttattcaatccatcttctttcttttagaaaggaggacaccgaggcttggagggaaaaaaagacttcactcaagaacttaagacaaaggctgtttcacagataactcatgcacctctagagttttcttatggaaatgcttaacagtatccctgttgggtcagtttctttcttttatgctgaaaaaaaaatcactttattgaggtataattggtattaaaaagctgtagatgtttaacgtatacagcttgataaattcggaggtaactatacatccaggaaaccatcaccataatcaatgctgtatatttgtatttatccatcacctccaaaagcctcctcccacgttctttatgtaatttattttttagtattgatttttcttttcattttgtttctgagacaggatctcattctgttgcccaggctggagtgcagtggcacaatcagagctcacggcagctcaaatattcctcctgcctcagcctcccaagtagctgggactacaggtgcatgccaccatgcctggataatttttcatatttttttgtagagatggggttctcactttgttgccaaggctggtcttgaaatcctgggttcaagtgatcctcctgcttcagcttcccagagtgctgagattataggtgtgagccaccgtgcccagcttaatgttgattttccttttgtggtaagagcacttgaaaaaaaaaatccagcctcatagcaaatttttaagtctacaacacagtataattaaccataggccttacattatacaggagttctccagagcttattgcattactggagctttgtaccctttgactgacacttctgtacttcccccttctccaacccatggcaaccacggttgtactttgtggttctgtgagttttgatgatttcagattcctcctaataatgggatcatgtagtatttgtccttctgtgtctggcttatttcattcagcattatgacctctgggtctgtccaagtaaatccaaaaaggatttacttcctttttaagactgagtaatatcactgcatgtatgccattttctttatccattcattgttgatggacatttatgttgtttccatatattggctattgtgaatagcggtgcaatgaacatggaaatgcatatatctcatggagattctgacttcagttcccttagatacataccatcatgggaatgcaatcaaaaccacaacaggaggtcaccgcacacttattgggagggctgttatagaaacaaacaaaccccccaaacagatgataacaagcgttggtgaagatgtggaaagaagtgaacccttgtctcttgtgtgttcatagaaacataaattggtgcagccacaatggaaagcagtttggaggtggctcaaaaacttaaaaatagaaatacatctgatgcagcagtctcacttctgggtctgcttctttcatctattgtgtatctcaaggcaaagcaacctgcctatgcctgatccctgcatacacaaacacagagaaatcatattaactctcaacctgttggtggctctgccagttctgttttgtttctttttttttttttttcgtgaatgactaacaatctaccatcagaaatgacattcataaaattatttctttctacagttatttctttgtttcttttcatctctaaacatgtcttattaagtacagggtggggagaacacagttattcctattaccactgatgttgttgatactcaactttggaatcttcccttttcctcccctaccctcacctcatctttcaccaaattcttcacaaggagagttttacaagctttaaactgcttccattttacagtggggaaaatgggaatacaaaatttggacatggattggtaatttcatgagtcaatgttgcgacaagattgacagcagcttctgtgaccactcatccagatgtattactgaaaacatgagggtgcaatgttgtggggaatccacctttgttatgtttttttctagaagggcctagaagcttctgaacttgctaggcacttgggagaaaattgattaaataaaaataatgaaatccatcccaccaacaaaaatagactgaattattgtttaacagaaattggaactaatgttctagggaggttatttgaacccaggcatagaagtgggagcatcatgatggtcagggaagaaagcaggtgacattagagactaatttgtaggcacatatacagtgtccttaaaatgagccatttatggggtaaagaaaagctgatcaaattgagatattttagaaagtatgcagtgtgaaggggttgatttctttataatgtttttaattgagttggatgaccttattgacaatggatgccttttgtcagcacgttgtgtgtgtgtgcctgcatgtgtgttcctcataaacccgtagctttctgcaaaaagggcattccaaaagaaagaggtgaaagaaaaatgcataaatgcacgataacacacgattaagttttgaccccatagattgttaaccttcaaagctaactctgcagtagcacaatattattagcaataaaaggaatttgctttgcccttttttaaattaccataaaccgattgactgagacagaatgatgttaatatttaagaagtaggacactagattctattatctcagaagctctgtcaccaggccctctctgtagtcctgttatctaattattgggcttaaattgcattagtgtgctagcaatttgtctaccattggaaaagtaattgacatttgggttactgcttcatatatgggagacttgctagctagttccgaagagtcctcttctgtcagggcagattagcttaatgttgcctagaagaaagggaagctctgtgttttaaggtatgctgcctctgtagctggttgcaatttggtattaaaatttcagttctgcatcaaagctgataagtcacctgagatgaaattgaacaaggttgtcgtgacaaagtaattaatggcattttttgactttcagatgactttaggggaagcacacttcttctctgcgtctgcttctgctgccatgtttataaatatgtatgcacatttacaaaacatctttaactgttgtcagatgtttctgcaggctccagatttatggttcccctgaattaaatagcaccaggtacatttggtgtacagcagtgatctggcattgacggtaaaggctgtgagtcttcataatatttcaatcatattttgcttctcctgacaccacacatcactgataggcactctctcttttttctatttctttgtataaaaatggaaagtggtgtgtttggttattctatttctagactttttttctgctcaactggttttggtttgtttaagagaagactttaagtacattcacaaatattttgcatttccctttgaacaagagcctacgagatcatacttttttttttttttttttggctatgtggagagcgtacctggaaaacagatgattttgatgtttttgatagccagtgcacctgaaagtcacaggcttctttcacttagatctggagtatatgtattctagggtcatctaaagagcagaacatagagatagccagccactattttctttaatgtgcaaactgaagatgaggctgaaaagtattcagaaattgattttaaaagttgatgtttctgtcttttaaggcacaggtcaaatctgactcaggaagaaaacttcttactatgatttgagcctcctctcttgcctctctcccctggctcactttagcgttcttggcttcctttcagttctatgggcaagccaggctctttcccgctgccaggacgttgtgtgtgctgttcctgttacctgggccgctctttcctgcttactttgccaagctagttacctcctatccttcaggaatctgctgaagcatcatgtccttagaggtctggttacttcctgctctgctccagttgttctcaatctcagtgtgattgcttccttctcaattcttgctatgataaacaactaatgtatttactcattttttgtcatccgctttcctcaccaaaacacaggctccctgatggcagaggtatcatctgtcctccttgtccctatatctccaggagctggcgatattaaatgttcaatgtttgttgaatatattaaattaaacctttcccaaatttccaccacaatacattttttaacttttcattttgaaataattatacactcatcagaagttgcaaagataatacaaatgagtcccatatactcatcacccagcttcccctgttgtaacctcttacatcagactagcacaatattaataccagaaggtgcagcaggctctccctcccttttactttaatggtgggtgatttcaacaggcaactgttatttgcttaatgtaatccttcgctattttatattttgggacattttatctccccttttctgatgcttccttcaaggacaacatcagctttttcagcacatggtgagcaccttgtaatacacttaattcttaagatagtgaactggaatgtgatcagaaagctactttttttttttttcaggtgcacttgcttaaaaaaaaattaaaaggtaaacagtctcaagttttatttggagttgctgagaagtttacccagcacacattttagctatgaccccctgcattcctgccaagcaggctcctgacttgggtcacccatgacagtgatcaaaattaaccctgctgctgctggactctttcgtttccctgtcttttccctttagctttctagtgctgttagtggcttctgagactctccttgttcagtgaagcattttgcataaggcacactttatcttttatctccaaagaaatggcagttaatgcaatctatagaaagccataaatgaggctgataaaattatctagcagccaaaaggttgctgcactcatttatctctgcataattcagaagctaaacgacaagattaggaagaggcaatccgtttgacagaggtgttactggaatgatgaaaatcaaggtggtttttgttttttccctcttacattttgtggggaggtggttaagagagggctgaagaagaagagattcaaggagaactcggtttctaaaatttttctcttgggcccaaaacatacctaagaaacagattgccatatattaatttaattatttgcctattgaataataatgcccttcccatttgatgtgcagattgtagaaaggtgacagtagacattttattttattttatttattttttgagacagggcctcactctgtcactcaggctggagtgcagtggtgcgcatgtaagtaactgtagcctcaaagccctgggctcaggggatcctcctacctcagcctgttgcgtagctgggactacagatgtatggcaccacatccagctaattaaaaaaaaatttttttcagagacagcctgttgcctaggctgagtgatgaaattttaaaatgtgactccaaattatcggtttacttcagaattttttttaacattagggagatgttgtagtgattaatctcccttaaaatttttatgtgtgtatatgtgtatatatgtgtgtgtatacatatatatgtgtatatatatgtgtgtatatatatagtctggcggtcaacagttcctttaatttctctgcataaaaactaaatgatagtatataatgaagtgtaacattataattatatatgttatgttttatataatgtagagtatgatccattttttgtaaaactataagtttaaaaaaatactgattactgataatgagtgatacatatttctgggtgatgggatatggaatttttttttaacttttgctttatacatgtgtgctttgtttaatttttttgttgaaagcaaacacctattgcattgagggaatatattacaatcattgggaagagtattttgtcaggggtagaagccgtttatttattcattcagcaagcatgtgcttagtgtaaggtgtgtctgaagttgagtagacatttagtggagggtaagcccaaagagtccctgcccctttggaggtcaaggctttgtctgtccccatctgggaacagggactcttacagacacaattctctcccctttatcttacaaagtgcctgatgtagatcaatcaacccatgtccgctgacggtgttgtgaagaaatacgtagcgctgcacagtggccatgttttaatcgttctgcaatttagaaattcaaatgaatggccactgctttaaagagtcagaaccttccatatttaaaaaaaaatatgcatttctggttcttcttggaaaattggagtctggccaaacactgcattcccttcctatcaaggcaaggattgatgtgaagtagtggcttctgtcttcgcatgaggtatagcctatgtggttttccccagtccccaccacttcctagagtgttccccctacaaggaggctaagtatctgtttatcttcaggccatatattgtgttacacttgctcacttcccccattttttttttgtgacccaactgggtctttgaagcatttatgctttttgtcctgtatcttacaaccttgaaggataattttgaaaatgtttgtgttataaaattggaaactttgcactgttttgagaagaggagaggacaacatagaaagcaggacaaacctgtgacaggagaagtctcagcatttactttaaaggtgaaatctgagcccttactcctcaagtagggagtttggttggtgtgaagctgctggagaatgtgaaggcatcttcacaaacaagcaaaacaccagggaagaggggccacgttttgtggaattaacctaacttttcagctgtctttagcagttggggttacattatgttcccctgggttgtgtgtgtttcttctgcatcaggagagatccctgcccaccttcagagaaacttaataataaacaaagaatgtacatccaaacttccaaacttccttgttaatccgtctatttccttagttgaggttgagcttaatgccgtctcatctaatacacgtaacctctccggtatcaggggccaaggccaagcaggcaatttgcagataaagtcaaacataattaagcagtaaaaactctgaccatacaggtggaatgaatgaatccaccaattgtgatcctgccaccatcctcctgccctaaaactcaacttgcttttctcctgagaccttctgaatagcaggaaagctaagcacagactgtctgatcttcagaaagggaggggcaagccattgtcactggatgattgaattattccttgtctggaagcaggtcgtgaaccagatgatgtctcaggttcttccagcctgagaggttttagctgcttgtcctacagtgaggcagagggaatcgatagaaacatggtatgaaggtctatgctcagtttcttattagtttcattgcttaattcctgcttaagcatctgctgctattattggtgacaagagcttgtatttctgtctctagactttttgtttgtttttttactttaaaagattttatatttcttctccatctaggaacatgacaaagttagaaatcttacaaaggggccaggcatgatggctcatgcctgtagtcacagcactttgggaggctgagaccggtggatcacctgaggtcaggagttcgagaccagcctggccaacatggtgaaaccccatctctaccaaaaatacaaaacttagctaggcatggtggtgggcgcctttaatcccagctacttgggaggctgaggcaggagaatcaactgcacccaggaggtagaaattgcagtaagctgagatcacgcattgcattccggcctgggtgacaagagtgcaattctgtctgaaaaaaaaaaacaaaaaaacaaaaaaacaaaaaaaaaaaacaccaaaaaaaaaaaaaaaaagagaaaggaaggaaggaaagaaggaaggggaaagaaaggaaaggaaggaagaaagaaatcttacaaagggatcagacacagtggctcactcctataatcccagcactttaagaagctgagacaagaggatcacttgagcccaggagtttgagaccaggctgggtaatgtagcgagaccctgtctctacaaaaaattagctgggtgagatggtgcatgtctgtggtcccaactacttggtaggctgagctgggaggatcacttgaaccctggaaggttgaggctgcattgagctgtgattgtgccactgcactccagtgcctgggtgacacagtgagactccctctcaacaaaaaaaaagaaaagaaaagaaaagaaaaaaattaaaaaaggaatcttatgaagatctcgtaataatgcctgattcttcaaagacatgggcacagacttgtcagctccaggcagtccttaagtgaacggtgcaatagccctagaggtgtcagctcagctgataccactttctcttaggaaaacacaaggtctttttttgtgttttctttgagggggccttgcattccaagtgtgcagttgagaaactgaacgttacaggatcagctgaaccaagtagagggaagaaaccctttggttttgacactgaagaaaacacacatagcactggggcaaactactgatggaaaacatcaagaaagatcttagacccttactccaggggatgtggcctaacggcagactggacagtaaccatgagacagagtgtttttgcttccatgagacagagtgttttcttcttctttttttttttttttggttagtgcctgaaatctagttaacttttttttttttttttttgggatggagtctcgctttgtcgcccaggctggagggcagtggcacgatctccgctcactgcaagctccacctcctgggttcatgccattcttctacctcagcctcccaggtagctgagactacaggtgcccaccaccacacccggctaattttttgtacatttagtagagacagggtttcttcgtgttagccaggatggtcttgatctcctgaccacgtgatccacccgcctctgcctcccaaagtgctgggattacaggcgtgagccacctcgcccagccaatctagttaactcttggtcttctacatgtgttagaatggttttagctttattgacagaaaatttgaataagggtagcttcagcaatatgtcaggtccccgtttgtaaagcaagctgagagaagtacctcttttctctctaggtatggcctttcctatctttgagtttaggatagctattaaaaatggaaagttacactgggtcttgtaattgtgcttctaagaattgattttgtacataaatgtgaaacctatcaaataaataacattccatccacttaaaggaatacatcttttatttatttatttatttatttatttatttatttatttatttatttttaacagagtctcgctctgtcactcaggctggagtgaagtggcatggtctcagctcactgcaacctctgcctcccaggttcaagtaattctcatgtctcagcctccagagtagctaggattacaggcacacagcgccatgcctggctaagtttttgtatttttcttttttagtagagatggagttttgccatgttggccaggctagtcttgaactcttggcctcaagtgatctgccaacctcggcctcccaatgtgttgagattacaggtatgagccactgtcctcggccaatatgctgttaagaatgaaacaaaaatctttatatggtattgacgttgaaaaatacctaatatacattgttaattggtgaaaaaagttgtataatagtatatatactatgattacttttatgtaaaagaattgtatatagacacatttgtataggtaacatactatatatttttaaaatatgcaatacatatgctatacaatatttaaaattacagataggtacacatatatgtgtatgtatgcatttataaagcatatatccacggctgggtgttttggctcacccctgtaatcccagcactttgggaggccgaggtgggcagatcacttgaggtcaggagatcaagaccatcctggctaatatggtgaaaccctgtctctactaaaaatacaaaaaattagttgggcatggtggtgggcgcctgtagtcccagctacttgggaggctgaggctggagaatggcgtgaacccgggaggtggagcttgcagtgagctgagatcgtgccactgcactccagcctgggtgacagagtgagagtctgtcaaaaaaacaaacaaacaaacaaacaaaaaaaaaacccactaatatgataatggagtaatctgcgtttttataattgaagatttccatagataagacatactctttaattttttctccaagacatatgtaccctatttgtaacctgaaaaaggtaagaagaagagaccaatagtaaaaaaaagtctgttattaacgaagaattgaagggccacctacttagaatagtcgttttacataaagaggcagacctgaacggccttttcccttaataagtgaagtatgttaattttatattcactgttgtggtcacctggagacatccctgcgttgtaaccttgtaggcttttaaaaagttaagtcacatcttctgtgccaaaaagtacctcattttgaactaaaaccttcaaaatggaagtcttgttattgagtttgatgtctatttattgctatatatttgcatttaaatacagaaactatatatttttttcttttttatgacccagtgtgtctttggggatagctttatgagctctttcttgaacgcttaattatttctttctaggtggctttgtcataggctgtcatgcttcattgaggtatcagctcagctgatctgttccactttctcttaggaaaggcaccattttggggccttcagtgggtaacagatttctgaagcttctcttagccccattctggcaacactgggctgatttacaaccggcaatatggaaaacctcctagacagctgcctcagctgcatttgaactactgcctgagagtctctggctgccttgacactctaacagaccctggcggcaaggcaggtaccgccttctgctatgctgctgatcattgctgaaaagttgcgtaagtcatgccaattgtttataacatgtatttaagccgtgtatgaacctgggagtcatgagtctgtgctcttatttcaatgtaataaagagaagaagaaatactggatggtttaaatcattctgtgcttaagagcaaagctgagaaccaccccaacttgtatccctctccatccctttgtctactgagcgaaagcgcattcaccatgctcagtctctcactctaagccagggttctcaacctcatcactgttgacatttggaactggacagttctttgttatgggaggggatggggtcaggggatgtcccatgaattattggatgcttagcagcatcccagctctctacactctagatgccagtacaacccactctcctaatcatgagaaccaaaatggctctagatattgacaaatgtcccctgggaagcataatcacctctgcttgagaatcactgctctgtcagatgtcccacccatctctcatactcaaataagtgtttctttcactccaagagcatgagtgggtgccttgttcctagttcctcaaatgagacaaacccgttgtcattgagacgttgcatgtgtacctctctccttctctcccactgtctccatctctctcatgtttcccttcttgtacccaccagccctacattgatgtcttgttcttcagaatctttaatatgctagtatgcattaggaatctccaaggatgaaagagtaggagggagagggagaaggagagagagagggggagagggagaaggggagatggagaaagagagtgagggagaaagagtgagagtgagagggagagggacaggaagagagggagtggggagagggagagagggagaaggacagagaaggtgagagggagagcgacagggagaaaaggagagggggagagggagacagggagagagggaaaagtggagaggaagagagggagatggggagaaggagacagggagagggggagagggaggggggagaggcaaagtgggagaaggagggagaaggtgagagggagaaggagagggagaaagacagggagagggagagggacagggagagagggagaaggagagagggagaaggggagagggagaaggaaagggggagagggaaagagggagaaggagagagggagaaggagagggagaaggagaaggggagagagaaggagagagagagagagggagaaggggagggagagggagagggacagggagagggggagagggggagagggggagggggacagggaaagagaaagaaggagggagaaggcgaggggagaaggagagggagtgggaccgggagagaaggagagggggagagggagagggagagggacagggagagagggagagagggagagggagaaggagggagaaggagagaggaagagggacagggaaagagggagaaggggagaggtaaaaggaaatggagagggagaggggagaaggagagggagagggacggggagatggggagagagaaggagaggagaaggagagggagaggagtagaggggaagagagaaggagaagagaagaaggagagggagagggacagtgagagagggagagggggagagagaaggagaggaggataaggagagggagagggggagagacaaagaggggaagaaggagagggaagggagagagagaagggcagagggagagagggaaaaggagagggagagggagagagggagaggtagagagagacagagaggggagggggagaaggaaagggagagggacagggagagaaggagaaggggagagcaggagagacagaagaaaacaggcagagagggaggaggagagggagagggacagggagagaaggagagaaaggaagagagggagagggggagagggagagaaggagacagagtgtgcatgcccatatttttttctgagtttgtttatttcccatgaacgctcccccaaatcccttgggactagcagttgtaaacacaccattgagaacattgcattcctttcttttcttctagatacttttcctccattaaccttgtctttttccttcctgtagatttttgcagcacattttgtctctccctcccttatggattgtttatcctgggtgatgatctgtgggcacatctcattccctaggtgcacacagctcttcgaaagcaagtattctgtggtatttaacccagcctgttttcttacatggagaaaggactgcataaacatcccaatgggttgaatgtgtttataacccagtatgaatcaactcgccacatgcccactgaaaggatccacaagatggttgcagtggagtaaaaggcagtgataactctctaactgggaagatcacagccgtaaaaagaatgagatcatgtcctttgcagggacatggatggagctggagtccattgtccttagcaaactaacacaggaactgaaaaccaaatactgcatgttctcgcttgtaagagagagttaaatgataagaacacatgggcacatggaggggaataacgcacaccggggccttttggagggtggggagttggaagagggagagcatcatgaaaaataactaatgggtactgggcttaatacctgggtgctgaaataatctgaacaacaaccccccatgacacaagtttacctatggaacaaacctgcacatatacccctgaacgtaaaataaaagtataaaaaccccatacagattttaaccatctactagacagaggtgatttcttttattaggctgtattccctctgggtcctcacagagaaacaggcatgagaccatcacgatggctgaaagaacagattctagttaatagttttgccttttgccaacaccattagctccccctcttaatccgaactgctgtatcgctgaagagagtgaccctctgtatttggcttgattttgttgtcctgagtagcctctgctagaaatatccacaagccacagcttcagccttcgagtgagcaaaagcaaagtatccaacaaactcaaatggtaactcaatcctgaaatgctgtaactttgatttgtattttccttctttctttattttttattttttcgcttagacagatatccccttctagctgtgctctctgatcccacttttgtttgtctctttatttcctctgcctactctgcctgaaaactaaaaagcaaattcttttatttctcacgtatatgcctccgaatgatttattttttaaaatgcagcttcacttgaatgttgactttttgaaaactttccctatttcactttttttttttccgctctcccttggaagctcttctttgataatcaggctggtcttctgttctttctacttttcttctgatcgttcaccttttgcccacttaaactgaagccctttggtgtatgcttggaatttcggcagttcaagttcaaaagaaagccctcttcaggtaacctgttctgacatatccgcatcttaacacaaagctttgctagattaatgggttggctaaaaacgtctctttgcttcagtcatagtcacctctgtgtatgagggtagcctcgtgtctattcatttaggggattcttttttttttttttttttgtagaattcgtctgaatctagaagcaaatgttattttattgaatgtcccactttcagagatatatttgagaacaaaaatgttgccaaaaatgtctgaatactaccgtatttcctttattggagcatgcatgtgttttctgtattttaacttttctgaaaagagggaagctgaaaaaaaggggaggatgtctcctacagtctcagtgatctctcagaattgagaaaacgtgataatcaaacatttcagtattatcgggaccttcctgggactgagcacacgtgttgaggggagtaccagggaaataaggagcatggtgaggagttaatttgcagtttgattccccctgctcctttgcatccagaagaagactgtgcgcctcctgtcccaggcccctgggtgtacccacatcgtggtgcatcactttgcatgttgacgggctgagtaacctgcttgtctcttgggaccacttcatttctcactgtgcttcagtatcgcacagacacctgacacctagtaggccctcacaaatatgttgcataggctgggcacagtggctcgtgcctgtaatcccagcactttgggaggctaaggcgggtggatcacttgagaccaagggtttgagaccagccgggcgaacatggcaaaactctgtatctagtaaaactacaaacattagcctggtatggtggcgcatgattgttaatccgagctactcaggaagctgaggcatgagaatcacttaaaccggggaggtggaggttgtagtgagctgggatcctgccactgcattctagcctggaaggcagagtgagattctgtctcaaaaataataaaataaaaacgttgcatgaatgaaaagttgtgtaatcagttctgaaagaaattttaaaaggaatgtgtccttccctttggtgctgttagaatgagtcccatacacattatttttaaccagatcatttgttgagcccacgtgcattttcagtagaataatattaaaaatgcctgcccattctccttgagtatgccaggtgaattctagagtcattcattgagctaagactataaacaggactagtgaagtctttttatttatttatttatttatttatttacttatttatttattgttttttgagacacagtctcactctattgcccaggctggagtgcagtggcacaatctcggctcactgcgacacctgcctccagggttcaagtgattcttgtgccttagcctgccgagtagctgggactgcaggcacccaccaccacacctggctaatttttgtgtattttagtagagatgggattctaccctgtttgccaggctgatctcaaactcctggcctcaagtgatcctcccacctcggcctcccaaagtgctgggattacaggcatgcaccactgcgccggccttagtaaagtctttctcttgtttttaataagaggaaagcccagcttttgcttcacctagttcacaacacgcaggatatcattgttctacatggaaaatttgtgtccgtggaattaaataatataatccctgggaacttccactggttcccggtctccttcttcagatattttatctgctaaatccgaagtcggaatctcagttaagcttattagttaagtcccaaatggagacaattgaagccagaaaaaaaaaaaaaagaagaaggagaaaaagtcctaattatagtttttcttcttaagtgctgcatgcaagtatgaatagggtattaactgtggttttcaacataaaagcataatagtcagtagcacgtatgtcaaaatgtaggcatattagaggctgttaggtgactcaggggccacatctgtggaacaggtacatatttatcttgagataccgagtcattaagaggggcaataaaaaatcaagtgtaaattgagagcaaaggtcacaatctgtggttggtgattttttatatgtctagcaccagcccttgctactttttctttagaaaatgagggccgagtgcagtggctcacacctgtaatcccagcagtttgggaggctgaggtgggaggatcacttgagcccaggagctcaagaccagcctgggcaacactgggagactgcatcactgcaaaaatacgcacacaaaaaagtaatagttatcctgcggtcaccagggcccagctactctggaggtccaggaggtcgaggctgcagtgaaccatggttgtgccacgacactccagcctgggcagcataactgagttgggagggaaaaaagtagaaaatatgtctcggtcaagtctgagcttcattttctattgatccagtcgtggtcttttccaaggaaattattgtatggagtgaactcgggcaattcacttaacctctcaattgctttatctgtaaaatgagaataggctgagcgtggtggctcatgcttgtaatcccagcattttgggaggccgaggtgggcagatcacttgaggtcaggagttcaagaccagcctgaccaacatggtgaaaacctgtctctactaaaaatagaaaaaattagccagctgtggtgttgggtgccagtaatcccagctactcaggaggctgaggcaggagaatcacttgaacccagaaggcggaggttgcagtgagccgagattatgctatcgtgctccagattgggcaacaagagcaaaactgcatgtcaaaaaaacaaacaaacaaaaaagagaataaactaattctcgtatcgattgtgataatacatgaaaagctcttagcacaaatgtaacataagtattcagtaaataggtgtccgtgtgtgtgtatcatccatcatctactatttatctttctgtcttcatctgtcatctgtctgtttctatatgaatatataaatgtatttatctatatttttctatatgtacatatataagggtatttatcatttatctgtatatcatctatctcgatataggtatctatatgtgtgtgtatatatatacatctctgtgtgtctgtgggtgtgtgtatatgtatatatacattcatctatccatttatcgtctatttctccatacaaacagacacacataacatacatttactttcttgaattgctaaattgactaatgcagatacatgttcatttttgtcccatagatactaggcccacccctttattctttaagactcctttaacacaacctgttggatttagaagactccactgacactggagggattgaaacaagagaaaaggaggaattatacttggtaatagctttcatttctcctagattccctcagtcctgtagactatattgagttataagtctttgataatttgtaatttgtatcattaatatctctcagtcagtgagatcttttgattaaccaaaacacagtgaaatttctgaaaagcctgttttattgtagccataaactatgtttacagagctgtttcttctaagagcttcaaaatggtttgtggtgtgtgtttactgtagatgtatttttcattaaaaagtaagataatgctatgactaaccgcccccccccagtggaaaataatgaagaaaacaaaagcattcatcacagtacaatcagcattaaatttgtggtgcctttcttccaccctcagatgtattttttaatttatgtgcctatgatcataatgaacatttaacttttttaaaataaacattgtcctatatgaaccaagtaatctagtctctataatcataacttaaccttaacttgtaatggctatcaaatacttcactctgtgtgtgtgtgtgtatgtgtgtgtgtgtgtgtagctatataacatttaattgtcattatattaggtgaaattaaattttactctttttattctaaataatgccccaacgggtaactttttccatatttaaaattatctctttaggccatatttccagaagtgtaatcataggattagggaaatggaaatatcttgcacagtactttacatgtatttccaacttacttttcaaaagggtcatagcaatgtatataactactagcaatgcatataaatgctagtttctctacatcctcaccagccttgggttttataattactttacattttcctaatagaaactgtatcactgctgtttaatttgaatttcattactagtgaggttgattgtttttatatgcttaatctctgggttcatcttcctaatagaggcctgccttgtgttttaacaattcagctgcccagataacacttagagagccatgagtaaaagcactctgttaagcaaaacaaaagccacatatttccaaagactgtattgtataatttcaatatgagtcagtattccaatgtgtcatccaaacatttcctatcatttgttaatatgatcttaagctaaattaatgtattagtccattcttatactgctaataaagacatacctgacaatgggtaatttatgaaggaaagaggtttcactgactcacagttccacgtggctgggacacctcacagtcatggcagaaggtgaaggaggagcaaagtcacgtcttatgtggtggctggcaaagaaagcttgtgcagaggaactcccatctataaaaaccatcagatcttgtgaaacttagtaactaccacaagaacagtatgggggaaactgcccccatgatccagttttctccattttgtaccatccttgacccaagggaattattcaagatgaaatttgggtggggacacagccaaaccgtatcaaccaatatatgagaattgatttatttactttagtccctatcataagggaagcagtggtccttcttcatgtttcctcatgtcactttttaatgagcaagtcatgcacaagacaccatatttaagaagtatggaagggcacacagtgaaagatgagtgactgaagacatgtttatttccagcatgatgtctttccaaacaactagccaaatatgtagtccaatggaaatgaatgttttagactagagagatatttcttttataaaatacaatgttatgaaataactctcgtgggtctttggtattcaggtgtggcaaatactgttaatttgtaaatcaaaattatttctgaccttcttctataccttgctgtcttccgctctagaggctgaaagactaatttaaaaaatttcatgcaagcttgaaactttctggagacaaaaacataacaaaaagggttagacaagagtgatgtacgttttcccttccctccttctgcttgcctggagcatagaagtgataactggagctgtgacaattgcatcatgaccatgaggagaatgtcaggaggattgcagatacatcagctctgacatagcaaccatcggcttctagatgaggacttccctaactttagtgcacataacaatcacctgaaggctttgttaagccctggattgctgggcccctgttccagagactgtgattcagtgattcagtaggtcttgggtagaatgtaagaattttcttttcttttattattattattattattattattattattatgctttaagttttagggtacatgtgcacaatgtgcaggttagtcacatatgtatacatgtgccatggtggtgtgctgcacccattaactcgtcatttagcgttaggtatatctcctaatgctatccttccgccctacccccaccccacaacagtccccagagtgtgatgttccccttctgtgtccatgtgttctcattgttcaattcccatctatgagtgagaacatgcggtgtttggtttgttgtccttgcgatagtttactgagaatgatgatttccaatttcatccatgtccctacaaaggacatgaactcatcattttttatggctgcatagtattccatggtgtatatgtgccacattttcttaatccagtctatcattgttgtacatttgggttggttccaagtctttgctattgtggatagtgccacaataaacatacgtgtgcatgtgtctttatagcagcatgatttatagtcctttgggtatatacccagtaatgggatggctgggtcaaatggtatttctggttctagatccctgaggaatcgccacactgacttccacaatggttgaactagtttacagtcccaacaacagtgtaaaagtgttcctatttctccacatcctctccagcacctgttgtttcccgactttttaatgattgccattctaactggtgtgagatggtatctcattgtggttttgatttgcatttctctgatggccagtgatgatgatcattttttcatgtgtcttttggctgcataaatgtcttcttttgagaagtgtctgttcatatcctttgcccagtttttgttggggttgtttgtttttttcttgaaaatttgtttgagttcattgtagattctggatatcagccctttgtcagatgagtaggttgcgaaaattttctcccattttgtaggtcgcctgttcactctgatggtagtttcctttgctatgcagaagctctttagtttaattagatcccatttgtcaattttggcttttgttgccattgcttttggtgttttagacatgaagtccttgcccatgtctatgtcttgaatggtaatgcctaggttttcttctagggtttttatggtcttaggtctaacatttaagtctttaatccatcttgaattaatttttgtatgaggtgtaaggaagggatccagtttcagctttctccatatggctagccagttttcccagcactgtttattaaatagggactcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgagggctcttttttggttccatatgaactttaaagtagttatttttttccaattctgtgaagaaagtcattggtagcttgatggggatggcattgaatctataaattaccttgggcagtatggccattttcacgatattgattctttctaaccatgagcatggaatgttcttctgtttgtatccttttttatttccttgagcagtggtttgtagttctccttgaagaggtccttcatgtcccttgtaagctggattcctaagtattttacaaattcttaggcagtgctgatgttgctggtctatggaccacacttggagtagtaagatgctcgattcattatgtgagaacaaaaaagccctatttttaaagtcactgcagttggtgttgcttgtaccctaaaaaaagtgaactgattcacctgctaggtctgcgtatttctgcttcatatgtaccacctactctagaaagagatgagattatcaatctaattgaatgtgtgtgaagatgacagaagcaacaatcagatggtcaaaagcagattaagaatcacttacttggccaggtgcggtggctcacgcccataatcccagcattttaggaagctgaggtgggtggatcacctgtggtcaggagtttgagaccagcctgaccaacatgggaaaccccatctctatttaatacaaaaaattagctgggtgtggtggtgggcacctgtaattctaccttcttgggaggctgaggcaagagaatcgcttgaacctgggaggtggaggttgtggtgagccaagattgtgccattacactccagcctgggcaacaagagcaaaactccatctcaaaaaaaaaaaaaaaaaaaaaaaaaatcactcactccaggaatttggggctgtccccagtcctgtgtaggctcctttccttctgggaagtgatggactacaagagaggtagagaacagtggaagagtttgaaggtgatctttaacaatggaaggaataacagctacaatcccaatacgtgctaactgaactgctaactgaagtaggagagttatatatatatatataaaatagtgcccctgttctgaaagcttggtatcaaaagctgcagggtttgatgtttagcaggaaagcattgctataacttgcgtatcttctaaaaaatgtgcccacatcctcccggtttgccttgggaacagagagaacttggttatgaagcccctttctccaaggattaattgaatcaagatcaaccctatctggaatgtacatttaatacccgggaatgatgtcagtaatatatgtaagagatttttatattagataactgctcattaaaagtcaatcctttcccccagggttttaaaatagaaagtattcaccttttgcaaatgaggatagtgaaatttactttaacttctgccacaatgaaaactggaagaaagggaattgctcacaatacaatataactccaccaaatttgcataatttaggcataaaatgtaataccctgctcacactcttttgtcttgaatgaaattggttttcaagtaatgtggggaatcataaccagctttaacaaaatggatcatgtcagaaagcaaaagttcctactagcctaggagacatgactgaagtgtgaatgcagtgtgcaacatctttacaaaagttgttcttgtgatttaatgcaaaagcctttgtagactttacagaaacactgaagccgtgctttttgatagttaatgggggaattaaccatttgaaaccttaagacaatctttttctaggattcttaaaatcatgggattgtaacaattctaaggatgttaaaagtgatatacattcctgcagttcctttccaaagatcacagagttctttgtgtaaattagtatttcccaggcctggtgcagtggctcatgcctgtaatcccagcactttgggaggccgaggtgggaggatcacctgaggtcaggaattcgagaccagcctgcaacatggtgaaacccagtctgtactaaaaatacaaaaaaaaaaaaaaaaaaaattagctgggcatggttgtgggtgcctgtaatcccaggtactcgggaggctgaggcaggagaatcacttgaacccgggaggtggaggttgcagtgagccaaaatcatgccattgcactccagcctcggcaacaagagtgaaactctgtctccaaaaaaaaaaaaaaaaacaaaaaaatatttccaataaattttcagcaatgtgaagtaagcctgtctatgtctttcctgtggcacaggtagtgaaactgaggtcaggaaaaggagtgcattgcccatgaccactcattgaagcggtgttcaagttttcaaggcacagactttctgaagcatattgtatgaattggtttttgatatattatggatagtgatatagtaaaggtatgaaagtcaaaagaattactcattgaaagcattggcctccaagagcattttctccccaaacctcttaaggggtttatatgaagtttaaatgttgatgttttccattatcttgctggctgtaggctttgaccctcactttctttcatctttaaaatgaagttgtaacagtatatgcctcatgtgtttcctgtgataattcaacagttaaaatgataatattgtggctggacatagtgccacacacctgtaatctcagcagtttgggcggtgaggcggctggattgcctgagctcaggagtttgagaccagcccggccaacatgatgaaaccccatctctactaaaaaaaaaaaaaaaaaaaatacaaaaattagctgggtgtggtagcaggcacctgtaatgccagctacttgggaggctgaggcaggataatcgcttgaatctgggaggcagaggttgcagtgagccgagattgtgccactgaactccagcgtaggtgacagggcgagactctgtctcaagaaaaaaaaaagtaatattattattactgcctcatatatctttttgttgcagacactattagctgtctaccctggccctcctcagaggtgagcatgaaccagaattccctggaggccctcttaaaacgcaccctcagagcgtttgattcagtgattctaaaacggagtctaagaatttgaattttttaaaagttctcatgtgttgccggtgctgcaggctttgggaccacattttcagaaagagtgttttctcttgtgaccattctccaatgttctgtgtttgttaggtgtgacaatgggtccatctagagcaaaaacaaacaacagtagcaaaccttgatttctcagggttttttttgcatttgggagtggccgtggagccagtgatacagaagtggaagtctgcagggtagggacagaagtgagcttgtacacaccttccagccacacgcccttctcctttcaggcttcctcttgcctggaagaagtatgctggtcagaaagtagggcagccatctatgaccatgagtccagaagccacactggacaatggaacaggaatattggagcataatgagttcctcaagaatagctgaagtagctctatagggccaacctccaaacttgtgttttgcgataaaaaatgaatatgtggttactaactatagaaatccttaactgaattatttctctcaggtacacacaaatcttttggacttcttattttaacaaaaggagaggtaaacagtagggaggttcctcaaaaaattaaaaatagaactaccatatgattcagcaacctcactgctggattatacatccaaagaaaatgaaatcaatatatcggagagatgtctgcactcctgtgtttattgcagcactattcaaactagccagggatatggccaggcacggtggctcacacctataatcccagccctttaggaagctgaggtgggtggatcacttgaggtcaggagttcgagaccagcctggccaacatggtgaaaccccatctctagtaaaaatacaaaaaatatctaggcttggtgacacgcgcctgtattcccagctactcggggccgggggagcagtgcttaggtgggagaatcgcttgaacctgggaggcagaggttgcggtgagctgagatcatgccactgccctccagcctgggtggcagaatgagactccttgtcaaaaataaaataaaataaaaactaaacaaaatagccaggatatggaaacaacctaagtgtccctgaacagatgaaaaggtaaagaaaatttttaacacacacacagacacacacacacacacacatacatatacatgccatgaaatacaattcagccttcaaaaaagaaggaaattctgccctttgcaacaatatggttgaacctggaggacattatgctaactgaactaagccagacatagaaagacaaatgctgcattatctaacttatatatggaatctaacagagtgagactcatagaaacagagtaaaatggtggttaccaagggctggtggctggcaggggagagttgttggtcgggtacaaaatttcaggtaggcgggaggagtaagttcaagagatctattgtacaatatggagaaatcatagttagtaccaatgtatggtgctcttgaaaatcaccgagtagattttaagtgttctcacacaaaacacaaggacgtgaaataatgtatatattagcctgatttagccattccacatgtatacatgtttgaaattttcatgttgtacctgataaacatatataattttatttgtcaattaaaaataattagaaacaaacaaaagtagaggtgaaggaaaaaagttcttggcgtttatattaaatgatgcacaaatcccctgctgtgccccacaattgttggaggacagtgggtggatgagacacacagaatagactcttccttggcccatcttattgagagaccatgttgtgcagcagtgtcatcctctgagacgtagttaagataaatgacatctccttaccttttaccccccgagactataatgtcattctgtagtctgaaaggtcatttgtaaagctcacaggattgctttagctgttaaaatagagagcaaaactcaaaagcaaacctctttctccaaggaaaatactatactttgaacagtctcatcgttctcctgtgattctaaaccagttcctctgcacgcagtgcagaaactagatctctcctgccactaggctcacaaggactcttgtggatctcgttttccccctatcttttgtcttacagtttccaccctcccttttgttctgtgtgtttgaatcaagaaccggcaaagcccacaatgatgtttgtgagcattaagtgacgcaaacacaataaaggattttgcttttttgagccgctcataaaaagagataaattgctttagctttttatgcatgtagaaaaatagagtatgagctaatagtactgactgaagaggaaccaggaagaaatttagtatgcatataaatttaatgcaaaataaaaagccaaatgtaaatattggtttccttccagattttcaaggcttaaaaaaaaaaaaaataagattttctttgcttgttatatttctgctgatggaaaacatcctttccactgttggaaaatgaatagttataaatatagaatacatatatcttagactcggtggtctttaaaattaagagtttggacttttcttttgatagaatgtggcatgtagcatatcgcatgtcttagaatattatttgtcctcgcgaaagtgatcctcatcccttattttaaaggaaaagaaaaggtatgattctccttttgtgcattcagtacacaaaaaattgcctgttatctagggtgtacttgactatggatctccttttaagtcaagactacacttacatgatggaaataataatggaaaattgtagataataataaatatatttttactccatcttcttcttaaaagactttatcgcagagagcaaatagcttttccctttgcaaaaacaagatgctagaagcatagaagagatgaagttaagcaattagtgattggaatgagttgatcttttaatttttttaaataacaataatcaccaatctcgattggacacttactatatgcttggtaattcatgtgtattaactcagttaataattataacaatgttgttataattataaggaaaaaatatttattatctccgtttcacacatgagagaattggggctttaactaatatgcctctgatcacgctattattctgtggagtgctcagaatggaaggtcagaccaccgcgttctaaaacttttgcttttaacctggtagtgtattagtcagtgtctgctgcatcaaaccgccccaaagcctagaggcttaaaaccaccatttattcaactcacaattccgtgggtcaacagtttggactaggatcagctgggtggaggagtgagcagaagtataaagaggtctgatgagggagtgagattagcagcttaatttcttcacgcataacaattcaaggggaccttcatttgcctgattgagcaaatatcttatgcggatagcttaaggaaagagctgcacacctgggctgtgaccttctgggagatgaagtccaaggacatttttagatatggatacgcatagtacaaagagatggaatagaaatgctaaagaaacatatacataaactccttggtgtggatgattcactcactgactgtatcgtgtgccatcctttatgcagacagtgtcaaatgttggtagaaaatgaagtagatgtagccctctgactttataggggcttgcagtctgggaggagaaatagtgaaccagtaaactgttacatcagtgaccacttgtggtacatgttaggtatgaaatagactatccagatagaaactaattaaagaagggtctatttgggtaagttggccaggaaaggttttttggacgaatgataattaagctgaaatctgaatgttgagaagggtacagtcaaggaaaaggaagtcggggctgttttagagatagaggggtgtgtgtgtgtatgtgtttgtgtgtgtgtgtgtgtgtgtaggtgtgtgtgtgtgtgtgtgttccttataagccaacaggtaccgaatttagtgtaggtctaagggatatgttgaaagatgaaggttataagtggaggtttccgtgtttaaattcagtgatgagactctctagctcttctcattttcttaaatgttgcccaaagaatcccataaacatggaaggaatcctacccaggtgctatataaagataaggatagggagcctcttggagatataattgaggagcaccagatggggagtaagatttggcttctcatgttggcattaacgctaatttaccatgtgtccttggcaagggcactctgcctgtccagaatttagttgcctaggctacagtgattgcctgttctgaatggttgatgagagctatgtggagaaaagagtctgaggccacttacaatcactgtgagccagaattctgtaattgattaggcatgtctgccctggacttggaaggagcaagtggtgttgtgtatgctgtatatgtgccattctctgatggccttttattttccagcacaatgttttctatggcttttatgactaattggaaaaattctgtagctttccagtttttttttttttttttttttgtcctggtattttaaaaatgcagcaataattgaaaacaatgagggaggaaaataaatacatcaaaacaatagtctgtacacttacttcaaagggatcaaataaagcaaattatgcacgggagggaggtggatttgtacttccctcgtttgcaatattattagtgtgattaatatacaaagaccaatatttcctgaaattcataatttgccctattcctccgtgagctttgtgtttcccagaataatcatgctgatccatttccttaaaaatgtattgaatgcctaagtgctcattttgcaagggcagcagcataattggacacagtggggaaacagcagagaagtggtttgcttcctgaggagaggagaatgtggtgtgagtaccggctggacggaatgtcacaccaggagggacctcatctctgcaccagtgtcactgagcagaatgcttaagggctatttatggaattagggctggaaaactgcagctaattctcaaagaagggagggcttccctggattataaaatatgtgttcttttgaataatgggaccgaatgagagtagaatgtttcagcatttttttcctaacatgacagccctttggggatcctggtgattttacaactggatttcatcttcatgaaattctgttatgtgtgatcgtttctgctccacccttccccttaaatagtcactttaaaagcatctctatcttgccttggagattgactttcttgttccagttgtctagaaaagtatttctatagtgtgagctttagaaactaggaacagaggaggaagatcggagtccttaggttcaaacctatttaaggtccgtgctctgccttgtgcctgcctgtctctgagtttctcttaatgcttttccaaaacagttcattaatgcagtgacctcgaggtcttgctcagatttgcttccacttggactggtgatgagaattgctggtgaagctgggtccctatgtgtttgcaggtctgtttagtagactcaacttctgcacatgtagcatccacatgtccagtctcttctgtgagatgtggacagcgtcagtgccagcataagggaatcagggtttgagaactctcaatatgggcagggtagccgtactgtgtaaacccatggagcgccattcccattgaattctacatcgtctgctcatcactatgtaggccccgatacagatctaacagggaaattcttgtagtttactgaggcagggccagctgctgggtgagatagagagagatgaggctggaaagtgggtatgagcccgatcacaaagcaggttatgtattgtgattgggtttggaatttattctgaattcacttgccgtcagtggcatttcagagaggcccctttagctgcacttgaaaggatgagttagagaagccccaaactggagggaagatacattaagacatgattgcagggtgaggtttctgttaattccttgcatctctatggctagcaccatcctgatccaaaccaccatctcccccgggtggttgcagtggggatctgacgaacccctgcaccccactcgtccccacctccacaccgcaacccaaacagcctgattatattaccccataggcagcctttcagggacagggagttcacattgctctcaggaaggagacaaaaatccttcgtgtgggtggaggcaaggtcttgcaagatttaaatgtcctcaccctctacattgttcactaagtctccacaccacaccagtcgccttgattttttatcaaagaaatggggtctcactgtgccacccagcctggagcacagtagagcaatcatagctcactgcagcctccacctcctggcctcaagtgatcctcctgcctcagcctcccaaagtgctgggattacagacatgagccaccatgcccatcccaactttattttttttccatccgtcctccatgttctctgtcactaaatgtggttcactctctctggaactttcctaaaccattttattacccctgtcttagtctattttgtgctcccataatagaatacctgagactgagtaactgataaagaacagaaatgtattttatcacagtttcagaagctgggaagtccaagatcgaggcaatagaaggttccatgtctggtgagagctgcatcctctggaggggaagaatgccgtgtcctcacatggcagatgggcaggctggccaaacactgtaaagcttcttttataagagcattcatcccactcatgaggggaggagcctgtatgaaccagtcacctcttaaagcccccacctcttttcaccatcacagtggcattaagtctcattgcccttcaccacgcacttgtttaacttgcttaatttttatttattctcaaaattcctgcccactgtcaattttttacagaagctaaatttcccctgtgttatctatcgaaaagcaagtatctctcctttttggcatttagttcagttgtaaatttacatttgtttatgtgattctttgattattatcttccttccaaaactgtaagtcccatgaggataggggctatttttattggatccttatcatttacccttcctgccacttagcatggtgatgtctcataaccagcagcattcagaaatagttttgaaagaatggataagagacagtagaagtctgaatgaaggcttcaggaataggagcagagaaatggggtggatgtgtggggttggtactttctgtgtcttaatgttctggagaataatgactctcaggtttttatctgggtgactcagtaatggtggcattgtaaacttaagtaggaatttttgaaggaaaacaaggttagaaatgaatacaacaaaggggccttttcatggtgaagaagttctgcatcttgattttggttgaggttacatggatctatacatacacatgaaccacacatacgcatgaactacacacagacacacacacacacacacaggcacacatgcagtgaaatgtgaacaaggtctgtagattgcactagtatcggtttccttgtttggatatttggttacaggtttggaaaatgtttccattgggggaaactgggtaaattgtgcataggaggactctgtaccacttttgcagattcctttgagcctgtaattatttcaaaataaaggtaaaaagagagggatctaaagattggcagggacattggtaaattcagtttgcaggatatggaatataatttgctccttacagactccactaagacctcacctctcctttttgactcaattattggcctgaaattcttgttggctcttcttgcattctaagagtgcagggctctgctgacctgtccacctggctttgttttcacccttcttccatgtggtcattcacatctcggaaggcctaactcccctcctccacacagaatgaatcacaaggtgcaatacttactttccacctattcagcagcataaaaagtccaagcaggtaggattccctccctttccaccagccccagctgtctgtctgtctgtgtgccatgccgcatatctacccagaggaaaagaggtcatcatatgaaaaagacacttgcacatgcctgtctatagcagcacaatttgcaattgcaaaaatatagaaccagcccaaatgcccatcagctgagtggataaagaaactgtggtgtgtgtgtgcgtgtatgtatgtgtgtgtgtgtgtgtgtgtgtgtgtgtgtgtgtgtatacatgatgggatatttatacatatatatatacttacatatatatatacacatatgtatatgataggatgctacttagccataaaaaggaatgaattaatggcattcacagtgatctgaatgagattggagactattactctaagtgaagtaactcaggaatggaaaaccaaacgtggtatgttctcacgcatagtgggagctaagctacgaggatgcaaaggcacaagaatgatacaatggactctggggactcaggaggaaagggtgagaaaggggtgagggataaaatactacaaattgggtgcagtgtatactgctcgggtgatgggtgccccaaaatctcacaaatcaccattaaagaatttactcatgtaaccaaccacctgttccccaataacctatggaaataaaaaaaattcaaaaaataaagtaggaaagaatgacactgacaaaatctataggaaatgggaggctatttgctggactagagtttctcataggcatgatttattccattgcttaaaagcaaaacatattccatactttatttttctaataaagaagagcaacatctgacttttactgagctcagtatgcctttgttgttgaaagagcaagctctggagtcagccctgattgaattcaaatcctggcaccaccaccttgaccttgggaaaactactgcatctcactttgtcctggtcccatttgtgaaacaggactaatagtacctaactcataatctgtggaaatcagctacaatgatgagctccaagagcttagcagagtacctgaaatacaggaaatacccagtaaatattagcctttattatgatgtttatttttttttttttgaggcagagtctcactctgtccctcaggctggagtgcagcagcgccatctcggctcactgcaacctctgtctcctgggttcaagtgactcccctgcctcagtcacccaagtagcagggattacaggcacgtgtcaccatgcctggctaatttgtttatttatttatttttgtatttttagtagaggtggggtttcaccatgttgtccaggctggtctcaaactcctgagctcggatgatccacccacctcagactcctaaagtgctgggattacaggtgtgagccaccacgtctggccttattatgatgtatttttgccagatgctttttgtgtgttatgtccacacgttttaaaaatgtatccgtaagagcaactttacccattggatattttattcctatagtgtaagtgaggaaatagaggctcagagtattcaagccatatgcccaaggtcacacagtggcacattgtaccatggagattacaactcaagtctatttggccccattgtaggtcacaatattctatttcatctctaaacaaactcaggggaccctagcattataaatgcaaaagaatgtttaatgcagataattcctcagcaaaatggagtgtctaaggaagtcttcgggtttgcttttgttctgcctgagccaaaatcatggtacttactaaaatcttactggaagtccctaaaatcttactggcaagggtacttttattacgaacacatcttcctataaatttcgttaggtatttcgtctttgttatcttgctaaagcagaaggctgttgttctggaatgtgaaatttatgaaattgcaatgttagaaggtggaagtaaatcctacttttccctgtggaagaagtttgagaggcagtgcttgggcaagtttcatccttatatggccaggtctgaccctataaaggtgaagggctattatagtggggttcagagaggtaagccaacgtgcctcaggttacctaactagtaactgagccccactttcatcagttctaaaaccagaaaaagaaatacctgccttattgggaggccaacacaggtggattacgaggtcaggagttcaagaccagccttgccaagatggtgaaacctcgtctttactaaaaatacaaaaattagtggggcgtggtggtgagagcctgtaatcccagctacttgggagggtggggaagagaattgtttgaaccagggagatggaggttacagtgagccacgatcacaccactacactccagcctgggcgacagagtgagactccatctcaaaaataaaacaaaataaaattaaaattaaattaaatgaaattaaattaaacaaagaaatacctgccttatggctggatgcgttggcacacacctgtaatcccagcactttgggaggccaaggtgggcgggtcaggagggcaagaaatggagatcatcctggtcaacatgtgaaaccctgcctctacaaaaagtacaaaaattagccgggcgtggtgatgcgtgcctgtagtcccagctactcgggaggctgaggcaggagaatgacttgaacctgggaggcagagattgcagtaagctgaaatcgcgccactgtactccagtctgggtgacagaatgagactctgtctcaaaaaaaaaaaaaaaaaaaaagaaagaaaagcctgccttatagggttgttgggaattagaaatgtctgtgaagtatctgccacttagatgacataaaaatattgctattacagtgatggcattaggtctgcattcacagtggaattacagtatggccaggcatattataatgaaggtttttaactttcttagaaacgaaatttgtccttttgaaactccctcttcaggtttgcccttaatccaggaacctctatcacattacaggcgcccagcagcacatcttaatatatgttaattccctttatttctgatactggagaatttaaatagtgactctcctcgtaggatgcctcctggcatggtggaaattgccagaagacaaaataacagattttatggtacttcgctgtggtttttccatatgtccaaaccctatccgtagctttcatgacccagataaagtgtcattaagtatgtattagtgattctcaaccctggcttcaaattcgaatcagttgggaatgcattaaaaactatcaaaatttggccgcactccacaccaaacaaatgagaatcccagcagctttatgctttttttattctctggtttttattgtttgcaatgtcttgctcttgttacatttttctgactgactatttttttaaaatgtttttaatgtttaatttttgtggttgtatatatttatggggtacatgagatgttttgatatagacgtgcaatgtgaaataattttatcacggagaatgtggtctccatcccctcaagcatttattctttgttttataaacatccaattatattattttagttatttaaaatgtaccgttaacttatttttgaccatagtcaccctgttgtgctgtaaggtagtaggtcttattcattctttcttactatttttttttgtacccattaacttattttttacaagctccttagttaagtgattttaacatgaaatcaaaggtaagaacctctaatataaagcttaccctaaagcccaccccattcccacagcatacactgtccaccatcatgtcgcttattcaatgattggaataaataacggtatgaatgaatgaatagccctctaggtcactaaatgatggtcatcttgtgctttgctttgatgttcgtcttatctttaatctcccctcgcagacttgagatacttcttacagtccttgttggggttatttctgggccccaccgtgtccgaagggaccacagtgtccaagggagagtatatggtcagtaaatgcttgtcatatgaatgaaaaatttatcatgaatacccgtcccatggcactcatggcagaattgttaatggagtcccacctgttaagaataacttattcttctccaactgactctttttttttttttttttttttttttttttctgagatagagtcttgctctttcacccaggctggagtgcagtggcacaacctcggcttactgcatcctccgccacctggttcaagcagttctcctgcctcagcctcctgagtagctgggactacaggcacccaccaccatgtccagctaatttttgtgtttttagtagagacgggggtttcaccatgttgaccaggctggtcttgaactcctgacctcatgatccgcctgccttggcctcccaaagtgctgggattacaggggtgagccaccatgcccagcctccacctgactgttaaaacattttctttttttgaattgatacgacagactttattgacatcataaaaataggtacgtgagtgtctgatatagtttgggtagttgtccccgcccatatctcatgttgaagtgtaatccccaatggtggggggtgtttcggttgtgggagtggatctctcaaggtgggaggtgtttcggtcatcggagtggatctctcaaggcttggtgctgtcttcatgacagtgagtgagttctcatgagatctggtcatttaaacgcatctcgctctactcctttttccatcattgccatgtaagatgccatgtcctgcttcaccttccgccatgagtgaaagttccttgaggccttcccagaagccaaacagatgagagtgccatgcttcctatacagcctgcagaaccttgagttaactaaacatcttttcttcataaattacccagtctcaggtatttctttatagcagtgcaagagtggcctaacacggtgtcctatatggggactaattgtctccaaggttattgaggtagttcttcagcttatcttaaagtaactgttggctttcatctctggatggtgtgtagtgtgggtgggaagaaccaactaagctccagattagttgatgcatggtgagggagtgaaccttcctcccctccttgcttgaaggtaccccaggccctcactcaggcatgaaggtgcaaactcactctttggcacaattttcaaactcttcatcatcttatactttgtctgcaagtacaaacccctactgaaacttcaccccaggccctttcccaatataaaccttgcttgaccacatgcagctgcccacaattatcactgacttcatttttatgattttctttttcctaaaaaaaaaatgccattgctgtagggaaggggttcacatttgcagaacactgacgtcttggctacttacaactcagccacatttggacttttctattccatttggtcagtctccaactctttcttgattcacctgatattttcagtcagaaatatgcacacgttatgcagttttccctttttcaatttactttctcaccatgaagttcccattgacctctccctgttcactgtactctgtgacatcacacattgtgtttctaccgactcaccctgatgtttttcccctttaccgtagatactccttctgaccacctcctctgatcaatacttcgcattcataataaggtgtattgatgtacatatgcacaaaacatctttcataactactcaacttatccctcctggaaataaaacccaatctcaacagtctttggatatcaataattaatgtagaggaaagcccagcaccccaacgcccctgccagagataaaaataagcgaaatatgcaaattcccgttcagacggggcactattgtaatgtgcaatgaagccatgcctatttaaaacaacaacaaaaaatgaatctggcctatggattgctggaatgttgctggcacaattcttgctgtcctcatgggtggcagacgtttaaaatgtggaagatgaaacatactgttgtgagcattgaacatcgcattacgaacgtgctcatggtacttaataaattgtcaaaaataataagactgctgccaagtctgaaagctataaatagctaaaaaaaaatcagacatgactgctgtggattcttttgaaagataattttcctcgtaagtaatttctatgagcaagagcaatacacagttagatggtaaagtctacattcctggctcctgaaatgaacagcctgtgaattagaatgctcccaaagacgtggtgttaaatagagttgcaactacagggtggccattacattaagtaatttaatgaacactgatactgaggaaataaatcaaatgcaaacaatcaacaccaatcaaggaagctgagcatttcaggcacttaaaatgtattaaatgagtgtttcaatcacagtgggtagtttttcacaaactctcttaatcagctagcatcattctcaacaaagtgcccatgcatgtaaacatggtgaactgcaaaagcccaacacattgacacatggacacttttaggaatggaaattctgcttagggttttcactgataggataaacaacagcagataaattgggaaaggtcagtggaagtcaatgttgtgaaacagaaaagaacattcatattttgcatgtagttaaaaaaataagaatttcaaacatagaataaaatttgaaattgaattccaggcagctaatgcacctcccaaaggtggtttttaatgtatctttgcgtaaaatttccattcatgtataagtcctgataggtgcatctttatttgtatatttattatgtgtacatgttatatgcatatatagttatcagtactataagactgataagtacattctctctatatataagtatatgttgtttattcaaacaggatcatatccaagctcactgcctttgctacttaatcaaatatctatcatgatctttccctatcagcctgtataggtctatggtctattgcattctgctcaaggttttcttttttttaaaaaaagtctttattttattttatttttttgtggagacaggatctcactatgttgcccaggctggtctcaaactcctggccataaataatcctcccacttaggcctcccaaattgctgggagtacaggtatgagctacagcgcctggcctggttggaataatattttactgtatgagtccatcatcacttatgcaactctctgcttgttaggcatttacgttcagtttgagagaggataatttattgcaaacacacacacacacacacacacacacacacacacattccttaaaatgtattattttatttcattctccttcaagtattagcattgcatctttttatagcctgtgaaactagggaagagagaggttaagtaatttgccagaaggcacccagataataaacacataacccttgttttaagcccagatgtccttttaattctgaccctatgcctttaatcactacactgaaggttgagtttttaaccaatgttaaaactttatcagagtcgtgatatatgtgtatacacttcaaaagatgtgtatgtttggaaatattgaagaaatatatgtccttgttttgttttctttctagagaaaaagccaggtacattactgtaatcaaaaggggtttctgaattgtaagagatactatcattgttaacagagagtgaaggtaaatattcccactcatgtaagagtcttatgatattcttattagtagctgcagttggataaattgatatttatacgtgtgtctgtgtgtgtgtgtgtgtgtgtgtttatgtacagtttcctctaggagaaagctttttcatttgaaaacattaggtgagttagaagtgctttgcttgttctttcatttccactctacatcttcacatctttgaagagattttgttctttgtactttcaaagaattttagttgaattgggagaaataaaagtattttgattctttaaactccaagtacttctggaggtttggaaagcatattccaatgttcttccaataatgcctgttataagtgcacttacagtcatggtgctgctgtttaagcttacggtttatgaggagacctgctttccagctgcagcctccctccctccacactcctgagggaggcatcttctgtgttatcctgcccaacagtcagtcctcgttcagcaagaagcagggtatcatgtcctctaatcatggtccgtatagactcgggtcaggtggacccacctcagattcccctgtggcccgtaacccgggcctgtctcatcagagcatcccaacccctgacctcagtgcatggcttggggatgagaacctggttcagccaggctggtgccactccattcagaaattgctgggggccctagcaccttggtttggttggtaggagttgtgatggtgggaacttagagtcgtcatggctccagtgatgggagatcctgcctgagatgaaagaccatccagaggggagtatatctgagatgaagagaggacgtgtccagaggccattgtatcaacactcatgttggatctgtaagacacccttcaatgtttagttgtataagccagtaaactccttctcattacactcctttaatgaagttttagttggattttcttgcacattatctcttagagccgtgagtgatgcagtcttctctcatttagggagttgtatttccatatatcttgccatctttactaaattccttggagaaactttgactttttaatataaaataaatacagtctatcactccattatcccttctagtctaccttctcagtcactgtcaacatttttttttttttaactaaaatggagatttggttatatccctccttccagcaaaaatgttagtggcatgccatttcctgcagaatgaaatccacgtgtttttgtttggcggtcaaggcctttggacatctgctcaacccagccttcaaatctcagtgtctcactcacctgcagtctttgttccagggagatcagagagtccaccctagctcaagatagcatgccctctgcctctagggataacatggtctgcagtgcaacatctagcaggttttacagttgggtatccaagtttggcgtgtgtctctgtaacttcatacttttttgtttttttgagatggagtctccctctgtagcccaggctggagtgcagtggtgcgatctcagctcactgcaatgttcgcctcttgggtcccagttcaagcaattctcctgcctcagcctcccgagtagctgggattacaggcatgtgccaccactcctagctaattattgtatttttagtagagacgggatttcaccatgttggctaggctggtcttgaactcctgacctcgtgatccaccttccttgacctcccaaagtgctgggattacaggcgtgagccaacacacccggcaaacttcatacttttgttcatgcttttggtgtgctgttttctccttcacggatttgtctctcctgctggtctgttttgccacattctggtgtcctttggcaaactgaatacccagttttgttttgttttgttttgttttgttttgttttgtttttcgttctggagtccttagtacctctgacagtatgatatttattatatttgatcagagtaccaattaatattaatattcttcctcgtcctcttgtttgatggtttcttggcagaagctatatcttccctgggatgcagaacattgctgaatcatagtagaaactgataggtgtatgtgaatgaactcacaaataaatgcgtgattgaatgaataatgcactttttaacctctatttctttgtaagcaagtcatgtgggttcatgaatataagcagaaatgatggctttaaattttttttcttatttgcgctttcttgtaggctttcattgctttaatgaaatctggccctgaataccttgccaaatacgttttccttgaggatattgataatggctttttatggttatttaagactccctctaaggccatgtatctgcaccaataattccagttttcatttatctattcattcacttttattaagcactttgtagagtgcagaccctggaccagaccacagcagaccaatgacaagatagcatgccctttgcctctagggataccacggtctgcagtgcaacatctagcaggttttacggttggacctgtttctttattgccctctacacactaataataatacaaataaccttctgtgtgctagagtagtggtaggtgctttgtatgcactcttgatgattctcttaacaactcttagtggtgttagaattctttcttcatgaagcagggcacaaaagctctgagaactaaagacacctgagaataacatctgcagctactcagcagtgaaacaagaatttaaaccaagttgtatttgaagccaaagccactacactgtaattccattccttggtcattccctgccttcatcaggatctccgcttggttttgttgagacacagagtatcttattctcatgtccttattcatagctttaagctctcttaagcctactcaaactatttcagtcaaaatatgcagtttacttttccctctcttttttctaaatgctctttaacttcaatgtcccagctttcttagaggtcctgtatatctgaataatcagaattattgtggttttaagtaacagaaacccagtttacagtagttttaacaaaacaacaaaacccaaatgactgtaggatgtattgaatcatggagctgagatcctcatcatggtggctcacagaatcaaatgcatgactcgtgaagtaagggtgtctaaggctgtacctcaagctttgtgactggaactgatggcttggagtttctgggacattctctcttgccaatatctacttgtttccagctcttagtgggctatagttactcttgctgtagacagacatcctccaagtagccaaggaagagtgagcaggcaattccaacattttatcttttaagcatcatgatctcccctttccccaaaagcaagggattgcaagtaacagaaccccatgccagctccagcataaaaattcctgggaaggactccagttggcttggctttgagctcacccatcacccaaactttgaggctaggaagaagagtgttactatgattggcagctctgtggtaacaccatgggttggaaaagtaattggccaaaaggaaaaggggtgattccaccagaagagagaaaatgagaaaatatgccaggatgcaaaatgttagatgtcacagtcatctatggaggcaagtgtcagactttgtgttagtataactgcggactggatagggagcgtttgtccaggctggtgctgccgcggtctctatcttgtttcctaaactccagtccattgtaggctgggcattgtggctcacgcctataatcccagcactttagatggctgaggcgggcggatcacctgaggtcaggagtttgagaccagcctggccaacatggtgaaaccctgtctctactaaaaatgcctaaaactagccaggtgtggtggcagatgcctataatcccagccgcttgggaggctgagacaggagaatcgcttgaacccaggaagtagaggttgtggtgagtcgagattgcaccattttactccagcctgggcaacaagagtggaactccatctcaaactaacaaactaaaaaaaattctgaccactgtagcattggtcactttcaatcatatcaaggtttagatcagaaatgatatagctactataacaattaaattcagtatgtgaaattgcaactgtcttggaaacgtcagagactcactttcttccccttgtctcccaggatcttgctggacgtgtaatagttacccagccttcaatggattgaggagcaacccaggacagtggacaaagccttggtcttgaatcacgtggtctcttctcttgttcagactttggcagctggtcacatgtgtgatttggaccctattacatcaaccataaaatgattgaagaaccagacatgctgtctttttcacagaagattagggagaggcagttagctcatgaatgagaaaatataatataatttgaacagttctgcagtcattaagatagtggtagtaacagccaatatgcatgttgaatgcttagtctgtatagcctgttgtgccaagctttgtgcaagaattactttattttatctgcaaaacaaccctacaggagtcatagttattatctctgtatcagagatacaaacactagagcatagagaagcaaagatacttgccaaagtcatgtagcaaaaacttgtcaaagctaggattcaaactcagatcctagtccttccccaccaggcaaggctgaattactctacagagagagagtgagtgcgtgcgagagacagagagggagagagaaaattctttcctagctctgccttatttctctggctctgatgataggaaagcagtggccacattgtcataagctccagtcactctccaagatggcagaacattccaacactggttaatggctctgggatcatcccatattgagggacatccatccctttgtgttctgacattgatgttactgtcagttgacagtgagctttatcatcaatcccttcaagtacaaaaggccactgttcagaaactgttattaaaagcagcctctctttttaaaagccgtctctcttttattccttccataataggagccagtgtaccagaagaggctgaccttaagttgcgcctgtttagttaaacaaacaacaaaaaaaaggaaatagaataggttatgtttttaatgtatttaagattggaggcctagaattagaatggaactgggggtgggaggagaggtggaaggcaggataggaaaaaagagaggtggccttggattttctttgcttttggataatgggcatttctagttaaatcaacacagtctatttcacagcctgtctcccggtgatgtatatactctttggacagtgttgtgggctgcctaaagatctcttttagccatgggacatgggtataaataagctttatgtagtcacagctactaagagcaatgtgcgtagagtatattctgaaaggagagggcaggatgctcattgtcatggcggatgaggtcaagagagaagggggaagatccccgagggatgcaaattggggagggttttaccaaacaaacttcctccagggtttttattcacattttaatacactttggggggaggtattttaattttaaaaagatgcatgtgatggaggggtgatttgatatagaggttaagtatgggttttataattgggcttccgagattcaaattcagctctgccatgtatgagtcaaagaagtcacatgcatattatttaacctctttgtgtctgtcttcgcatccatagccacatgcattagctgtgaatattaaatacgtcaacacatgaaaagagcttacaagagcacctggcacacggggagtgctcagagagcatttgctgttattacttgcattgtctgggtgctttctatgtacgaggtactgaaggaacagtggtggatgagacagccacagtctgcctccatgagccgtatgttcatagattaaaataaggcaacaaacataaattgatcattatacattttgagaatgctgtgaagggccctcagttgggattagtccagcccccactcccctccccaccaacctactcaagatcgttaagaaagacttccatgagaaggtagcatatgggcaaagatcaaatgcatgaccagctatgggaccaacacaccaatggaaggaaacagaagatgcataggttttgagagcaggaaaaaaagagacttgtgaccataatcccagcactttgggaggccgaggcagatggatcacgaggtcaggagttcaagaccaggctggccaagatggtgaaaccccgtgtctattaataatacaaaaattagccagacatggttttgggtgcctgtaatcccagctactcgggagactgaggcagagaatagcttgaacccgggaggcagagattgtagtgagccaagatcgtgccactgcactccagcttgggcgacagagggagactccatctcaaaaaaacaaacaaacaaaaaaacaaaaaccagaggagagactggtattttagaggacctgaaagcagccagcataggtagagagtagtgatcaggcagggagtggcccctgtggaggtaaggcatgcaggcaaaggtgagatctagccagggcatccatgccaagtgatgacatgattttaatcttagaatgatgggaaaacactgggaaggttgaagagtgtcctgatcagcttcacattttttttctttttttttttttttattatactttaagttttagggtacgtgtgcacaatgtgcaggttagttacatatgtatacatgtgccatgttggtgtgctgcacccagtaactcgtcgtttaacattaggtatatctccaactgctgtccctccccactccccctaccccacaataggcccacattttaaggttactctggcagtggagcaggaaatggcttgtaggtgcggtagaaaggccaaaaggaggttcttgcagctgactaagcaggaggtgatgttaagttagcccaggcacgtggcagggtgagaacagccccttgcagataaggcatgctggttcagctctgtgttctcttcaccctgcttacctaaccaccttcatctgctgttgcttagttgcttgctttcaccaggctataagagcagggactatctttttttcccttcttctttatacattctgtttctagtcctgtgtcaaactcaggctaggtgctcagtatgtgtttaatggatgaaatatgcagtccactgctcattagaatgtttaattttgcaagcccatattattagaatattaagcgaactacctcatgactaggaaagtcactcctcttgacattgcaatgtttgtgatgcggaggtgggattctagattatctttatgtcaaagaaaatgagcaatgctatggaccttgggcagagcacaggcagtacatggcttggcaatgtattttctgtaggaagatgtccccttagctccttatctgtggtatttcaaccaggagccctagttaattttcatgcaggagaagcctttgaaacccaggcctcttttatgctctgggaagatttgagaggggtcatccctgtttagattggttctctgcaccagtcggggaagcctgccggctgttctcagcatggagtatgttgcagagaggaaacagaccagagaaccagggcacttcccagcttgaatcaggcctgtcttgtgtgggttcattattttgttggaaattaatcccccaaatggcagacatagtatatttgaatgtgaactgaccgtgcattgcttggccaagtgagagtggtttttggattatccaacctggttgattgtccctgtctctgaacccttccattagtgtagataattgaaagatacctgattttgttttttcacacccaatttgatgtccttatggcgtttgagatggggtggggagtgtgagatggtcagaatcagcttgctgtcatttgcaatggaagcggtgaagtttgcaaacagcagtaccacttaatgagagcttgtcatgatatagccattgtgttcagctcttaatcttaatgaccacattcactcctcacaacaaccctacagtaataataacactagcacttatttggcatttactatgtgtcaggtgctgttctaaacactgacaagtattaactaacttaactcacaaaacaaaccccagagagtgagagtcacatggactaggatctgcacagcacccttgatattaaactggggggaagccctgcttgtgacatgggtaccattattattctcctgttacaggaagttcagaggggttaagtcacctgcccaaagtcacacagtcagtgtgtggagggggcaggaactgaactaaggtccttaggtctccaaagtccccttgctttcttttcattgcagcagcctaagaaccaaaagttagatatttattatacatgggtttggggctctttacagtatgatagaaaaatatactgctttgctaaagcctccccctaccccttggaggtagggggagagagagagaaaaagagagagaaaaaaatgagaatagcaatgccagctaaaactctgctcgaagcacagagtttggtgcatcagtacatgtgagttaagggaacaaccaaattacaaattaaatgaatgaaaaaactggacccaaactgatgcttcctcttcatgctgcccctaatgacgtagctggagtcacttcacttcgggacttctcaaagccctgcctctccttgccagagatttacgtccagtctgaggatcgtttaaacttcctcctctgtccaggattctgtgaccttacttacaaggcggctgtctgctttctcctaaattctgtctcctggttccgaactcattatttctgatccaaccaattctgtaatgtcagcctgtgtaacataatggaaaaacaaacttagggtaaaggaactccagcgagaattttaggtctccttgcttgatggaggttcgtggccctgagcatttctaagcatcctcatgttcttctccaacttcccctatgacagtccagtcctccacatggggaagagaatgttttatctgtacctgtctttggttttgcgtccctgcacccatcccgcaacttgatagaaaaggcagagagcccttctgccatttcttctctcaatacgcccccaccctaaacctgaaaagaagaaaggtaaaatgggctattcaatgaggagtctaggtgttgggaagaagaatctatttcgaggatctgaaattggaacctgcatcagaccttaggataaagataattatcatgtgcagaaaattcaattaaaaacaaaacaaaaaagaagaaaaagcatcttccaagttgttcttaaagtgtagttttgcaatgactatcactgaaaagtaagtgtggagatctgttcagttctgtaattgagttgggaagtcgacccgaaggaattccaaaagccccagttggccagaagaacaggatatgataggatgctgttgatctgctttcgtttccatgccaaggtgttttgttttgttttgttttgttttgtttttggtaaacttccattcatgactgtgtacagccagaagccagtaggacaacagtggctttgtaaatttgcaacagatattcaaacaagataagtacataattagcatggagcagcagatgaggtagtgtggaagatttaaattctgcgtagggaattagcaaacagttcctgataaccacattctgaacatgttgctgttcgatgggtgtgaatggatcgtgtaggcacagcccatctagatggctaataatagaagggattgttcaagaacaacaatgtattgtgtgcttaccatgtgacaggtaatatgctagactacttagtgatataatgctttcttcgtaatatctctgtgaggtaggaactattataatccacttttacagataagggtgctgaatctctgattgttgaagggacataaccctgccatctctccttcttgatctatatatgtatctctatctatctctatcatacacacacttacatctctaatgaatggcaaagcttggatttgaatacaggtctcatctaactccaaattctatttctcctagaggaagttcaacatgagggatttcgacaaaaaggttgttaaaagcagtctgattgactttcacctaacagatctttccttcatcatcgccatcattttagctctctgcaaagtcatcacatctgtcactgacgttgcacctactttgacacaagctgtgggctacgcaacttgcatgcatgaactcctggggaactcacagcaaaccttcataggtaggcaccattatcctgatgtctgactcaggtgagaagccagaggctcgttttccaaagtcacatacgtagaggtcctgccaggacccaaatttggtgactctgagtcctacattttgcacttttataaccacacactcttttgttttccaatcaaagcttgatcaatggttgatgatagatagatagatggatagatggatggatggatggatggatagatagataatagttaaaagaaatagatgtgtgtgtgtgtgcatgtgtgtgtgtgtgtgtgtgtgtgtatatatatatatatgtacctatacagaatatatacctgtatccatatctatataaatttggaattcaaaattgtgctgtctttctctttcttctgagtcgtctgaccagcttgctgcatttgcagccgccacagtgcatttaactccttgcttgcattggtattcctctttggagcagccccgtcacaacagcaattggaataaaaccccaaagagtagtgcagagaatataaatgggttatttttcacctcaactcaagtaggacagaactcttataaagaaccagggaacaaaggttccatgacaaacatacaccaggggactttagctctctctgatacagcctgtgtgacataatggaaagacaaacttacgatcaaggaattccagtgagaattttaggttgccttccttgatggaggttcgtgggcctgtgtgtttgtaagcaccctcgtcaatagcatttatcgaatatctactctgtaagtgaggctactggatattgcctgtctgtataggttatcatgcagtgagcctggatccatgtgaactaaacagatgtattcagggagaacgtttatctctctaaataagcaattgtttatcaacaatataaatatctatctacataagtgattgtttttatcaaaatcatgagaatcattaaagagaatttacggcaatgagattggaaataagagctttctggataattaaaagctgatgtgaaattaaatcttttattttcaaaggcagagtagcagagtgcttaaggatatgggattggtaataacccttgctgagtttgaagcttgatcccaaggtcataccatcttgggcaaggtgactatgtattcttaaacttggtttattttctgtggtaggaagacattttaacatctgtgcaaccttcataaacctttgactgatgcaatctagtctctgcgtgaaattccattcaatgggggaaagcaatacaaaatgttaaaactgaacattttttaaattttaaagcattttgaaaaacctcttttaaaattaacataaattaaaacaatatatttctgtcttctgaaaaatatacatgtgaaaggaaattcaattcattatttttagtaacacttctcatgtcctctttcctgccctgttctctgggatttacatggtgcaacaactttttcttggctttccccccatgcccacccccactgtctaccgttgacccattcagattctctccctttatttcccagattattaaaatatatatggttttggccttttttcagtcagtgcttttattccttctcttcttccttccatctctcccaccccttccttttatgtcattcttaaagttcagcatcacatatgtccgcggacctgtttttcagctcagcaggctggggagagagataaacaagaaagaaagtctgtggattagaagggtggtgagaacctggaaacatttccatatcaatactttttggtttaatcaccccatttgctttgacttctacctgtcaacagcacacaatgaagaccaagccacagagcctccattcccaggcatgggaaaactctgtgggtagttgagatgcagcagtacccaggttcacttggggcccttttctccatggtcctgataggacagatgagatgcgaaaggatggctggtattttgctcggccaagaggtgaaagggcacaggacaggaggagagtggaggaaatgcaagttggtgtgaagctgtagctctggtgagaataatgtatgagatgagtgcatgcatggtgattttgactataagacccaagaggacccctcctcatacaaatggatacaggtgggtgccaacaggaggaatgcgctgttcagtgtcctataaggttagcaatcatgtcagttttcaaagtccacagagaagtggtgcctgtggtcaacctggaagtatgacggattggataaagaaaatatgacatatatacatcatggaatactatgcagccgtaaaaaaagaatgagttcatgtcctttgcagggacatggatgaagctggaaaccgtcgttctcaccaactaacacaggaacaaaaaacgaaacaccgcatgttctcactgataagagggagttgaacaatgagaatacatggatacagggaggagaacgtcacacaccggggcctgtacttggtggggtgcaaagggagggagagcgttaggacaaatacctaatgcatgcggggcttaaaacctagatgacacgttgatgggtgcagcaaaccaccatggcacatgtatatctatgtaacctgcacattctgcatgtgtatcccagaacgtaaagttaaataaataagtaaataaataaatggaaaaaatgaaagtaggatcatttccacatagcagtctcttatctgtaacaaatatatatatatgtgtgtatatatatatatatgtatatatatatgtatatatatatatacgtatatatatgtatatgtatatgtgtatatatatgtatatatatatgtgtatatatatatgtatatatatgtgtatatatatatgtatatatatatgtgtgtatatatatatgtatatatatatatgtatatatataaggcagtcagaaagaaaggatggtccaagaaggggaagaggttgggtaagaggactgaggcagaaggaggcaggcatgcccaaggtcacctggaacccctgacccttcgagagcagagttcatccttggagccctgggacagagatgtgaatcagagaagttgatgagaccagattgtatggatttggaaagttagtctaagtctttgaacttgacattggttgcagttgtgaattttgaaaagcgattaaaccgatataatcaatatgtcaacatgtgcttaggacaggtgctggcagtctcagcaccactgacactttagccagaacacttttgctgtgggatgctgccctgtgcattttaggacacttcgtagcatccccggctgccactcatgacatgccagcagtgtcttcctctcccgttttgacaaccaaaaatgtccccagacattgactaatgttccctgggaagaaaatcacctttggttgagaaactctcatttaggaagatactgctaagagcagtatgtgggatggatagaaggcatatgaaaccagaagcaagaggaccccttagaaggctgtagtaaaacttaggtggagaagtcctaataatgtgtgcaccccaaagcgtaaaccttacacctgcattccatgagtagatgtgagatttgtaggaactttgagaaagaagaatgactggttggagtatttagcaggaagcacaggggtcattttttgatgtattttatttattgaatgatttggttacttatttttctttttttaatttcattttaagttccaggatacatgtgcaggacatgcaggtttgttccacaggtaaacatgtgccacagtggtttgctgcacctatgaacccctcacctaggtattaagccctgcatgtgctagctatttatcccgatgctctccctccccatgatgtattttatttttctgaatctattaaaaatggcccctcagccaaaggagcaataaattcactcccagcagggatgttagccaaatctcttttccccattcaaattaaaagacagcatcaacaatatttgatgttgaatttcttcttcttctttttttttaaacttttaagttcaggggcacacgtgcaggtttgttacataggtacacttttgtcctgggggtttgtcgtacagttgattttgttgcccaggtttaaacttactacccattagttatttttcctgatcctctcccacttcccatcctccaccctgaagtagacaccactgtctgttgttcccttctatgtgtccatgtgttctcataattcagttcccatttataagtgagaccatgcggtatttggttttctattcctgcattagttggttaaggacaatggcctccagctccttccatgttcctgaaaaggacatgatcatgttcttttttatggctgcatagtattccataatggatatgcgctacattttcttaatccactctatcattaatgggcatttaggttgtttccatgtcttttctactgtgaatagtgctgcagtgaacatacacatggatgtgtctttatactagaatgatttatattcctttcggtatatccccagtaatgggattgctgagtcagatggtagttctcttttttggtctttgaggaatcgccacactgccttctacaaaggttgaactaatttacactcccaccaacagtgtgtaagcattccctttgtgtccgcatgatgttgagtttcttaataaaattcccatgcccttatcccatcatcttttgtaacgttttatttatttttaaaactccttacaattgtccatttttgtctagggtttactcagttcttcactgccagctggccattaaagacatttggaaagaaaaatgctgatgcaactgtgctcttgtacatattgcataatcaaccaaaatagccccagaagtgattatgcttgaagctacaatgacagcaaagatacactgtcattcaccttgaccccatttgagatcatatcatttactcaagttcattgtgtttctaaaacaacaatttctcttagaatgagtgtgtttttgattgtgtgcccgtgtgtgcacatgagcatgagtgcatgtaccgatgaattttacactctgtttccaaataatcttccatcacaattctgtttatctcactcctctgctcaaaaaccttcagtggctccctattgcttatcagatcaactccagggcagtgtcatactgaataccttccatggcccaaactctgttttcctaatttcatcttgtcctgcaatattttctgcatttcactttttaactaagcaggataattgtttaaatgtttatagtatcaacagggggactatagttaataatcattccattgtagatttaaaaataactaagagagtttagttggattgtttgcaacacaagggatgcatgcttgaagagatggagaccccattttacatgacgtgattattattcatttcatgcctgtatcaaaacatctcatgtaccccataaagatatacagctatctatccacaaaaatgaaaatttaaaaacatttaaatgtttataaaaatgaagaaatgaatcaatgcaattccgagttcatttacaacattagatgactgatacagaataacaagatatagactttcttatgctcactttctaaatcaaaattgttatttgcttctgacagggtattcggtatttaattttactatgtcagacaggaaatctagagctgaacatttcaagtgtgcgtgtttatgaatttttcattaattactctgactgaaattggatacaagcctagcttagaagatcacccattgcttatttactcagattgttatccaggtcacctactatccagtgaaatctatcattattcctttacttttgcttgtttcatttgccacatgctttgctggaggtcttttcagtctccctcctctcctctctagccgttaggcagagttcaataactgatgtcttgaaaaacttcatcaggactcacagcctaagcaagtgaaataagctgccttcttggtcagtggagacagatattttcatgtgtctctgtgtccactttcttcttttaaataaacttgtgcaagaactaggtaaaatatctttcttctttctctctcctcaaactcactttgccttcctgattcacctccatgagttcccttttatagtttctgggacttggggagggtggcccagtagcgacgaaagtgcaagtggattggtgactgaaaaatatctgcgatcatgtacgtagaacaaataaagataaaaacactggggccgggtgcagtggcttatgcctgtaatagcagcactttgggaagccaaggcggatggatcacctgaggtcaggagttcgagaccagcctggcaaacatgctgagacgccatttgtactaaaaatacaaaaaaaagtagccaggcctggtggtgcacacctgtagtcccagctactcaggaggctgaggcaggagaattgcttgaacccgagagatggagggtgctgtgagctgagatcgtgccactgaactctagtcttggtgacagagtgagactgtctcaaaaaaaaaaaaaaaaagctgatgaaaataagtccattcccactttcaaatctctgcacatggcccttttaaaacaattcctttatcttcgtgagaaatggcatttgagttttcgaattctagtaaatagccaccactgtaaatctgcaggctcttgatcctagatagccattgcctctacagaaatctgttgagctgagggaaagttctcccattgaaaataattctgtactttacatgcagcctgtggtccctgacaattgatatattgccgcagaattaaacacgcttttctttgtcattgctgggcagagatgactttggtttatgaatgttccagattactttctacctgcctgtctctgctgagtacagagaagtttcatgacccagtgcctccatctgattccagatgacacatggatgaccccaaaatgttgcagccaggttggaatgaagtgggccagattgggaaggacttgactggattgaaatggagtgggctagactgggatggagtggaacagaatggtagagagaaatcagcccataggttttaattaaaagccattgagaaatggcttttaattaaatatctgtattaagatatatataaagaaggcatggcatgcatccaggccaggcatggtggctcatgcctgtaatcccagcactttgggaggccgaggcaggtggatcacttgaggtcacgagtttgaggccagcctggccaacatggtgaaaccccatctgtactactgataatacaaaaatgagccaggcgtggttgtgcacacctgtaatctcagctactccaggggctgaggcaagagaatcgcttgaacctgggaggcagaggttgcagttaggtgagattgtatgacttccttccagcctgggcaacagtgcaagaccctgtctcaaaaaaaaggaaagaaaaaaagaaaagaaagcatgcactctttgagaaaatgagataatgttgctgagaaggagagtaatgttgattttccctctggacatggacaaaatatatctgtgcatatatattaaaattatgaagactatcttttgcttagagtgctatcatcaacttgtataacttgcaatgtgttaaacctctgcacaagagggagaaattacctggaatatacaattttttaaaaccccacaaattacagtcactttctgcctagggttgtgaacagatgactgcaaggagtttggctttcacattcccagtggatgagagaaaaattggcaattgtttcttcccttccaaaaagcagaaaagtcctggcatatcctcattgtgtgtgtttcaccaaaatcagtgtctttgagtcctggtgttagcctcatctttcagtttttccatcttgaggaaggttgtttttttctctacctagtaccaaaatagtacgtcaaagcaaaagcaacttccaaacaactggctgttccagcctctcccagatgtcagatgatgagtgtgattgttttagtggctcagacatgccctgtgagagttattatgactgtacagcagacaaacagaaacaggctgctgagccatttgctgggtcatccttgtcctgggaatcgagccttctcagccagtccatcaagcttcaccagtttcatctctgtaaatgtccacattatggtgttttctttgcccattggatcagcgaggctgtgagtgacagaaaactcaggaaaacagtggcttttaaaagttaaaagtaggctttcttcagtccaggcatggtggcttagcttctaatcccagcactttgggaggctgaggcaggtggatcacttgagatcaggagttcgagaccagcctggccaacatgatgaaaccccgtctttactaaaaataccaaaaaacaaaacaaaacaaaaacaaaaacaaaaaaaacctagctgggcatggtggcacacatcgataatcccagatacttgggaggctgaggcatgagagttgcttgaacccagagacaaaggatgcagtgagccaagctcacaccatcgtactccagcctgggcaacagagtgaggctctgtctcagaaaaacaaaaaaaaaagaaagaaagatggatattttctttttaaataaggtgaaacgtagagatgacaaagacagaggtgcagagactccttgacttcccttctattgcggtattccaccatccagaactcttggtttctgccttcccatccaagacagtggcttgatttcggccatcataccctcattcagatgggcaggaaagagaatcgggaaagttaagtcacatttcctctctttaagggtacttcctggaagctgcatgtaccaatttcacttacatttcattatcccgaaattagtcacatgggtacctctacctgcaaaggaggcttggaaaaaagtagtagatattatggcggtggggggtggtgagtgtgccctgctgaagaattgagtctcttcttaagaaaaaaaggagagatggggaggaatatgacactgtttgcctcatccatattgagggaggcagtgttcactgcagcagcatctcataaacattggttaaaactatgcgtttgtagttattttgctgtcaactggattgcaacatctttcccaacaattgattgctcacttttattttcccactttcattcggcctggattatgttatgttctgggaagaatcggaacaaagggttgagggctgtgatttattatttaaagtttaggtgggaagaataggaacagagaaagatgtctctgccagctgggattgtgtcttgctcatctttgattttccttgcaacctcagtgctcctttatccaaggaagcgcccattctaagtaccagggtcacagtgggcaacaaggcaggccatctcacaaccctcatggaaataacagatcaaggtaagtaccatcaaggagattaatgggatgaagttgcaaagaggcactgaggccgggagagggcccgctttagatgtggagtagacagggaaggccactttgagatgacatctgatttgtagcctgaaggatgagattaaagtcacccactcaaagaaccagggagagagctgtaatgtgcccaagactgaaatggggaaaagtttggtgtgtttaggagaacacagagtgcgcctgtgggttgaaatgggttgaaatgagaaagagatgccttatatagagaagatgtcttatggttctgctcaatattggagggtcatactttctgcttccccaggaattttgtttgaaatccatttgtgtagaagttcttagtcaccccagtcttagctggaatcattctagcatagaattgaatttgagcattgagaattcatgctcaaactgtggggccggtgtgggatggcaaggagaatgatatctatgttttcacgggagggtataaagagagaggctctgataaacacattcaattggttgggggaaaaaagtaaacttatttggaggtacatttctggaatcgcctgatttgaactgagcagtgcagcctccatttatgaaaccatttctctgaatgtttcttttttccaatctgtcttccattctgacagatgtggcatatcttgtgcccaattcaacaagaactagtctccctcccttcctgtctctctctctccttccttggagcttagagcttctgctagtgtctgctcctttcctagttggcatggtagttgctccatttgtttttgtaaattgaggaattttctttttgtttgtaaatttgtcattatctcctacaaagcaccctgccatggttttttaaatatcttgatgtcttcacattggaagcaccactccatctgtgaactagatgcttccatcccaaaatgccattccaaaggagaaagttggaaccaaaagtgttggtagcagtggccaccaccagcaacatccactattacaggattaataggaattaaatctgcttcagctgtgaagtgagccaaagctttacttgcaagtggggctaaaacatttttttttaaggatttaccttaggtaaattgttctagactattttgactttaatttgctgagggtgaatttgcaatggggattcgataaccttactttcatagagtctcaaaacttatagttacacaacttcttctactgcctgcccattgctttgggttccttttcttgcaagttgcaatttgtttggtttttcagtgttctcttggataatccatctggatcactttgactaccaattttgcagcttcctgtcatgaaaggagaaaaactgaggtccaaggaagtatgcaaccgtttccataaccatgccatatccctgcatgaacttggcttgactttctcccagtgaagttgcactgggtatgcagtgggctccagagtcatcaaagtggctgttgcccttaaatagtcattgcattatactgttctcttgttggaaacccgtcaaatagtcttaaactgaagttcaaatgctcccactggctggtaggacagtgagtgatcagattgcatcaggcccatcggttctcattgcttaccattcacctcctcgctcacatcactacagccacagggcccttctctgcagacctcagacccaccacattctcttcctcttcaggaccttttgctcatactctccccaccgctaatgtgctcttccccttccttgtcttcagtaatccggatcactggatagaagccacaccccttggaaagcagtccctgaggcctaagtgccaggcaggtgctcagctcttttttgcagcctatgttgtcttttcttagcatgccactgaaacttctaactatctgattagtttttttgttttatttctgtcttgctcaggaaatttcttttccttgattacctctgagtccatggcatatgacctaacatgtagtaaatgtgcagtgagcattggttgaataattgagcgaaggaactccgagttctgtgtgtgggaaccgactctgataagagcaaacgcttgacacccaacctcgtcctgcctcccatgccgcatcaccctatttccaatattgtgggtggggctgatggttcaaagatgtacttcattccatttcctttttccctacaagccattcaacaaccataacggagacagttatctggggctattttctagatgttagacacgaggaaacctgaaaggaacattatgctcttcgcacactcacgtgtttgtctggttaccctcgggcctctccaagtggccctattttttttttgacattttgtttttttgtttgtttgtttggggtttttgtgagacagaatcttgctttgtcacctaggctggagtgcagtggtgcagtctcggctcactacaacctctgcctcccaagttcaagtgattctcctgcctcagcctcccgagtagctgggattacaggtgagcaccaccgtgcccagctaatttttgtatttgtagtagagacggggtttcaccatgttggccaggctggtctcaaactcctgacctcaagtgatccacccacctcggcctcccagagtgctgggattacaggtatgagccactgtgcccggccagtttgacattttgcatagcttacaacatttattaaacatttaaagacctgaagccttcttaaattagtgtttctcaagcccttcttgtgcaggatatgtgcgtcaaccaccaaattagctttggtgcacccagcgtgggaaaaggagcttttctttaccatgttagctctctcaactgccttccttgtacttttagcttcagcctttttgaaccaactactctgaattcttcagaatccctctgtctctcttccttctgccccctcttctgcccagattcttcttgctccctctcctcctcacttcttgtacatttgaaaaccctgtcttcctagaagagtcataccactttctcttcacatgcagcatccttcctggtattgtgggtccatggtaggtttattattccttactaaacattctggcttctctttttgtggtatttcttactgcaggaggatttttacatccccatcaggaatggccatacatcttacttcagctaatgaaacgtgggggaagtgagatgtgtcacttctgggcggaagctttaagagcctctatctgactcaacttattctcttctcccactgtggagagatcagtgagtcacttctctatcagcctggacccttgagagaagatgacatgtagcaaagccatagctaaaagacagccaacacatagcctagtgagaaataaatcttcactgctgcaagctaccaaaagtctgaggtcagttgttactgcagcgtctagcccatcctgaatgatattccgttgtgtctcagaagccatttctttgtaaaaccttccaagtctctagcagaatctcagaatctaagagtcttagaatctatttactaacaggccagacacaattgctcacgcctgtaatcccagccttttgggtggcctaggcaggcagatcacttgaggtcaggagttcgagaccagcctggccaacatggtgaaaccccatctctactaaagatacaaaaatcagtcagtcatggtggcacgcgcctgtaatcccagctactcagggggctgaggcaggagagtcccttgaacccaggaggcgaaggttgcagtgagctgagatcgcgccattgcactccagcctgggtgacagtgcaagactctgtctaaaaaaaaaaaaaagaagaagaagaagaagaatctatttaataacagaatcctagaagaaccttagaatgttagaatccttaaagtctgttgcttttatcatgtgttcccatggcattccctcataattagtttttttgtctgtcttctgtatgacattcagttctgtgcaggcaggaagcttgattgattcgcttctgaattccatactcttagcagagtgccttatgattggcattcagtaaatcactgtgactgaaagcaaatggagcagtgcaaagagatttctggctccaccaccatcatgaatatttttgatgggataggttctagtgaaaagcggtatccacctctatggaaacatggtggtgtttgaagagttccccacagccacacaaaatggaggcacccacttggaactgaattgattatttatggcaaactctggatcccagtcaggaatctgaaaaagggggaaaaaaatctggggcagtgatcaaaggaaaagtatttggagtatatgggcagaaaaaaaactgtcagagatattaatttaaattcacaattcatacactaacaccgtaggatcatgtttcttaggtcaatgaactctactcatattatttggtgatttgtttgacctctcctgataaaccccgatttcactatctcctatgtgtccctcctcttctgttccttataggacttgaggggtgtccccttggcttcttatctctttctctgtagcctaagagaaatagaccatggatatatccagttgcaatggaatccagttgattcctttgtgaaaacgagcaacagtcctttctttagcagagaagctagagtcttatctgacagatttctttttttaccataagtttttctgaaggtatgggtggaagactgcaaaaccctgaacatcaacaagcttcagtgttgcagatactaggagagatctactcctaaaaccaacaatcaaaacttctgtttttttccctttttcccatgaaagagtcaactgaattcgggtacaagtcgcttagatttaccaagtatgataaccaggtgtgtggctattctgagcatccatagctgaaacccacaggttggacatcctgtgacagtttcttagcctgcaaagaacagtgagcatgaaagctttaaatgggctattacctttttatatttatcccaaactgctaaggtcagcattaaaatttgaccttttccctgccaacccgtttgaagtaattaacccctgtgtcttgaaacacaaggaagctatgactttgttattaaattctcataaagagcctattaatattaaaattgcttcactcttgggctgaatgtattaatggccttgcactgggtaaacacaaaccctcagctcagtgttttaaaatgcatgagttgagggcagagcatgttcttccagctaccttttctgtagcagaacgttatgccttttgtgacagtttcctctccaatttgttcaaatgcttttgttttgaatctgtgtccctagatttacatctctttatggggaaactcatttccctgctagcaggtatggagcaggtcgaatggaggagaactcccgtgatgacctctgctcccatcaccctaatcatcgccttccaggacagtgctcagaccctaactgtcttggtatgaagcacagcttgtgattattcttttagtgggtccaagatagctgtgttcaagcacctgtgaaatgtgcttaaaaatgcagaggtacgcaatccagcatagacctcctgaatcagaattgacagagatgagaccttcctgaatctgcagtataaattaaattctcaagggtttactctagtaaaccctactgtgaacctgactatagttcagtttgttaattcaatcattcaaaatatgcatcgaacagttattatatgccagggtttatggccttgggaatacagtggaaaattgaaagagtcaggtgtttgttcttagggatcttacagttcatcgaagaaacacacaacacacaaacatgcaagtaaataattaaaaatagttataagtggacttctggaaagatgaagtaaacattttttccctgttcctccaacagagaacaaacaaaatgcctaaacagaagtgcagtcttcccgcagtatcagtgggggactggttccaggacagtccaaaatccatggatgttcaagttcctgatataaaatggcatagtgtttgcatataacctaaaaacatcctcctgtatgctttgtggggacatatctctcacttcaagcatttatcattttatttgtgtcatctgatatactttaaaacatctttacattacttataatacctaacataatataaatgctacgtaagctatgtcagcaagagggacaacaacaataagcattagtatgacagatttctcttctctgctgttttcaaaattatgctgtatgcttaagcaaaaattatactgtctgatgtgattggtgaatatgtaagtagtaaatagttgttatactgtcatttaatttgtattatttttattgtattgttatttatttttaaatttttggaatatttttgatgtgtggttggtagcatctgtggatatagaacccatggatatagagggctgactggatatagtttcaaatcactgagtaaatcccaagtcagattaactgaaggaaatccacaccaagtcacatgatagtcaaacttctgaaaagtcaaggcaacgaaaacatcttggaagtaacgagagtaaaatgcacgccatccttataggaggaaacccatttgaaagagaacagatttctcatcagaagccacagagtcaaataagaaatggtgttttccaagtgctgaaagaaaatacttgtcaactcagaattctgtattgagtgaaaatctccttcggagatgaaggagaaatcaagacattttcagatgaagaaaaactaaaagaattggttggcagctggtctaccttaaaagaatggctgaaagaaattttctaaacagaaaggaaaggataaaagcaggaattttagaacatcagcaaggaggaaaacaaaaatagccattaatatgataaattttccttctctggtgttttcaaaattatgctttatctttaagcaaaaattataataccatctgatgtgattcaaaatacaagtagtaggaagatttaagacaattatattttaaatggggagaggaagggaacataaagggagttaagatttccacacttcattcaaactggtgaaaacatagcaccaggctgtgacaagttatgtatgtatattgcactacctagataactgctaaaaaaatctgtaaaaggagattcactcaaacagactataggcaaattaaaatttaattatgaaaatatttcagcaacctagagaaaggcagaaaaggcaaactgaaaaacacaacagaaagaacaaataaaaaaaaaagaataaagtggcaaaattaagcactaacataccaataattacattaaatggcaatggcctatatacaccctttgtaagagattgttagagtggattaaagtatacaacctaactatatgctgttgacaagaaactcctttcaaatttaatagtataggtagactgaaagtaaaaggatggaaaaaagatagagtatggaaacatcaatcaaaagaaagtaggagtagctatattatcagataaagtagatttaagagcaaaaaaaaaaaaaaacaactagaaatagagacgatatgtaatgatacagtgatacagtgtcagtccaacaagaatagcattcctaaatgtgcactcattaaacacagagctacacaatatatgaagaaagaaatatataactcaaaggagaaatggaagaatatcacaattatagtcagaggctaaacactattaggaattaataggaaaactagactgaaaatcagaaggataaagaacaatgcaaccattatccatcaacgaggactaatcaacattatagaacactcccaatgacagcagaaggcgtttctttttcatgtccatgggagatatcctgggccataaaacaaagtttaacaaatttaaaataattgaaatgatacagtgaccacaatggaattgagttataaattaataccagaaagataacaggagaatctgcaaacatttggccactagacagcacattgccgaataaattccatggattaaagaaggagtctccaggaaaataaataagtgtattgggcagaatgaatgtggaaatacatcacaatttgtgggacacagctaaagtaatactgagaggaaatttatagcaataaatgaatacattagagaagaggaaaagcttcaaatcactaatctaaactcccaccttaagaacatagaaaaagaggccgggtgtggtggctcacacttgcaatcccagcactttgggaggccgaggtgggcagatcactagaggtcaggagtttgagaccagtctggccaacatggtgaaaccccatacctactaaaaatacaaaaattagccgagcatagtggcacatgtgtgtagtcccagctactggggaggttgagacaggagaatcatttgaatccaggaggtggaggttgcagtgagtcgagagtgaccactgcacttcagctggagcgacagagcaagaccctgtctaaaaaacaaacaaaacaaacagggaaggaagttataaagatgagagcagaaatcgatgaaattcaaaacagtaaaacaatagaggaaaatcagtacaaagaagaagctggctttttgaacagatgagtaagacaaacctcctgacaaatctgagcaaaactgatagagagatgacacaaattatcaaacagggaatatcactacagactttgcagatgtcaaaaaggtagtaagggaataccgtaaataactccacaaacttatctttgacaacttagatgaaatggaccacttccttgtaaaatacaaaccatcatattttactcactgtgaaatggataatttgaatgtcctataactgttaaagaaattgggtttttaagtttaaacctcctaaaaaataaatctccagatcaggaggtttttgttagagaattctaccagatttagaatgaagcattaacaccaagtccatatatcctcttccagaaaacaggagagaaataagaacttctcaattcattttataaagctagaattaccctgacagtgaaacaggacaaagccaggagaaaaaagaaaagaaaactgtagactaatattcttgatcaccattgactgtaacaaaatattaacaaatagaattcaacaatatataataataattttataccttgatcacatagggtttatttcggggatgttaacactggttcaatatttacaattaaatcaatgtaatctaccctaccaataggctgaagagaaaaatcattcaccgaatcttatcaatctatgtagaaacatacttgataaaattcaacacccattcatggcaaaaactgtcagaaaaacaggaataaagagaattgaatttgttaaagaacacctaccaaacacctacagctgacatgctgataccacaattaaaaatgcaatgtcatgtacaatgactcaaaaaatatacttaggtgaaattttaaccaaatacaacttatatgtgaaaaactgcaaaactttttaaaaatttaaggggagacatcattttcatggattggaaggctcatcatagtaaagacattgattctccccaaatggataaacagatttaatagaatttctgtaaaaatcccggtaagcttttttgtggatagagacaacactattctaaaatataaatgaaagtgccatgaaatttaaaaagcttaacaattttgtaaatgaagtataaagtgggagaaatgagtctgttcaaaaacaaaacttcttatatagctacagtaatccggtgtggcaatggcagatggatagacacatagatccattttaaaaagtgtatagaacccagaaatagacctacataagtatgtccaactgatttttgacaaaggtgaaaaggcaattcaatagaggaaagataacctttcaacatatggtactagagaaactgggaattcttgaccaaaattttacattttatacaaaaaaggctcaaaatggatcattaactttgatataaaacataaaactataaaacatttagtaaagaaaaaagaggcccgttacattggctcatgcctgtaatcccagcactttgggaggctgaggcaggtgagtcacccgaggtcaggagttcaagaccagcctggccaacatggtgaaaccccttctctactaaaaatacaaaaattagccaggcatggtggcttcagcctgtaatcctagttactcgggaggctgaggcaggagaatggcttgaacctggaggcagaggttgcagtgagccatgatcatgccactgtactccagcctgggcagcagagtgagactctgttttaaaaaaaaacaaaacaaaccaaagcaaagaaaacagaaaatctttgagatttaaagctaggcaaagagtttgttgttgttggtttttttttttttttttttttttggcaaagtttcactgttgttgcccaggctggagtgcaatgacaaaatctagactcactgcaacctctgcctcctagcttccagcgattctcctgcctcagcctcctgagtagctgggattacaggtacatgtcaccatgtccagctaatttttttgtatttttagtagagatgggcttctccatgttggtcaggctggtctggaacttctgacctcaggtgatccgcccgcctcggccccccaaagtgctgggcttataggcgtgagccaccatgcttggcctagagttcttagaattagcaccaaaagcacagttcataaagaaaagaaaatgataaattggacttcatcaaaaaaattttttaaatcttgctcggcaaaacaccctgctaagtggatgtaaagggaagcttcagacttagaggaaacttttgcaagccatgtatctgacaaaggaccaaaatctagaatatatgaggaactctcaaaactgaaccaaaaaaatcaagcagtgagcaaaggacatgaagagacattttactgaagaggatacacagatggcaagtaagcacatgaaaagatggtctacatcattaaccattaaggaaatgaaaattaaaactgcagtgtggtatcagtgcacacctatcagaagggctaaaactaaaacagtggcaaccccagtacttgcaaggttgttgagcattcggattacatacacatcgctggagaggatgtcaaatgatacattcccatagccactttgagatatagtggagcagtttctttaaatgtaaacacgcagttatcagataacctagtaattgccttcctgggcatttattccagagacatggaaacatgttcacacaaaacctgttcaccaatgtttgtagcagctttattcataatagatagaaactgggaacagcctacatatatttcactgggcgaatggctacagaaattgtggtatatccataccacaaaatacaacccagtaacaaaaaggagtggactgttgataaatgcatgcaacagcccaacagcctgaatgaatctccagaaaattatgccgcatgaaaaattccaatttatgtaaaattcttgagatgacaaaataatggaaatggagaacagattagtcattgccaggggttgagaggagacagggaggaggaaggaaatgggtgtggttatgaaagggcaacatgaaggatctttgtgcaaatggaaaagttctgtatcttgactgtattagcgctatcatcacgcaatcccctgatatcatactatggttttgaaatcacccttgtgggaggaactaggtaactacacaggatctctgtaacattattgcctacaaattcatatgaatctagaattatctcagaatgaaatatctaatttaaaagggacatttatgatgttaataaaactaagtgctattcagagaatgagcagaaggaggacagttgaactttcctacataggctgttctttttaagaagaagagttggtcattgatccattaatgatgagaaggaaccagttctgtctagtggaaaagcattctggacaacagagtgagacactgataccgtgtgctgtgaaaacttttagctgagatatgtcgctcttgtccggagagtgacatggaaatatccagtcttgcttctacagagagtcacattgtctggtcacacctatcccactgcaagacaatgtaagtgtgtgtacatacctacatctctgagattattttatctgcaagcttcagggcttgcaaagttagtatatagctgagcatggtggcgggcgcctgtagtcccagctactcgggaggctgaggcaggagaagggtgtgaacccaggaggtggagcttgcagtgagccgagatcatgccattgcacttcagcctgggcgacagagtgagactccatctcaaaaaaaaaaagaaaaagaaagaaaagaaaagttagcatctttcaatcagcaaacatttattgaacactcactgtaataacaactggtggtatttctgcagtgcttgactgctttcagaatgttttcacacacctgatctcattcgcatctcataactaccccgtggaatagtaattattaacacctttattttcatttcacatctgagggcactgagactgaaaaaatggtatgttgttgtgtttgaatgtgcttgatatggtagacatgggggagtcacatctgtacatatagtcctaaagtctatatttatttccattgtgtactgatgatagtactacattatttgatataataatggaagggacatacctatttttaaaaaacactactttggaggaattaacagtttactaaggatacataaatgccatagaaaatattagcaagaaatagaagaaagtgattattttgtctgccaattagtatgataaaggtaactgaccttgtgaaataaagaaggaacaatataataatatttaccaaatattttaaacaattttgtcatcaccatttaccaaataaccctaatacttccctccccagttgatacgtgatggcaagccagggtgagtttttgtatattgcattgccttaattcattgattgatgctggtactgcaggtgttggattattataagtttaagctattctttaattgtacagatagtaagtcttctctcattggaggggatggatatgaagggatttaacatttttttaaaatttaaaacatcatttctcattaaataaatacctttttcttttttcctgcagtgaagaaaaacatagataaacggatgactcaaagtggaagggaacaagtgattttgttacagtcgtcagaactgtggccagaatcattttagataaatatgtcaaatgtgtggaatgtcacggaagtggtcgttttttgtcctcccagcttggggcacatgctcatagaaatatgtgttagttattgagagtctttttttttgttaagacagtcccattctgttgcccaagctggagtgcagtggcacgatcttggctcactaccacctctgcctcctgggttcattcaagtggttctggtgccacagcctcccaagtagctgggattacaggagtgtgccaccatgcccagcgaatattttttgtattttttagtagaaatggggttttaccgtgttggccaggttggtctggaactgctgacttcaagtgatccttccaccttggcctccaaaagtgctgggattacaggcatgagcctccgcgcccggctgagagtcgttttttaatgttggattcatatttatcccacacattgactggttatgcagatactggtcgcattaagttcccaagaagttctcctctctgctgctattctttatcacagcatcctgtttatctgtttccccacgtgtattacagtctgtaattatttcttttctttgcttttttttttttattaactatgctccttccaggaatgaaatctccatgaagacaaggaccatgctcattttattttgtgctttatattcggtacttagatcagcgcttgccacaggacaagtggtcagtaaccatttgtgaaatgaatttgatttaaataaatgtacatttccagaagaaatgggaaatagacctacctggttaaatgagtgtttttatcttaaccggacatgggttatcactttgtaaactaaaaacaatcccatctcagtactgtaccagacacaattgccggaggttcagaaaataattaaagttttgtaatgacttataaattgcattattaaaaagtcaattttcagctgggcacagtggctcacacctgtaatcccagcactttgagtggccaaggcaggcagataacttcaccctaggagtttgagaccagcctgggcaacatggtgaaaccccatctctaccaaaaatacgaaacttagccaggtgtgatggtgtggttctgtagtcccacctactcaggaggctaaggtgggaggattgaatatgggaggctgaggcagcattgaaccgtgatcgcagcgctgcaccccagagagagtgacagaacaagagtctgtctcccaaaaaaaaaaaaaaaaaaaacctcaatttttatcaggacacagaggctcacaccttttatctcagcactttgagaggctaaggcagaaggatcgcttgagcccaggagttggagatcagcctgggcaatagagtgaggtcgaggctgcagtgagccgtgattgcaccacggcaacccagcctgggctacagagaaagaccttgtctcaaaaaaaaaaaaaaaaaaaaatgtccattttccaaatccgtgctgactccttggatcccgaccgctgtatataactgctggtttcccctacatttaatgtgcggtacagagaagaggggtggcaatgaagacgtgtgctagagacatacaagattctgattgcgattaggattactttagaaacttttgatctgctgggattgagtcatgattctgtaaagcccttgaagaaatacggttaccctcgtgtaagctgtctttcacagctcacttttacttggcccggagtttaattccaagtaatcattgggtaggtgatgaggttccgcttctccttgagctgaacgaattaaaatgtgaagttcccttactttgtaagtgggtaggagttcattggacataggccattagtcacttaatttttatgccatataaatggggcatctctttgccattttgcatgaagggactttgtggaaagccataaagaggggcagtaaatgtgcaggcaggtactttgtgaccacgttgcccctttcggctcagtccccttttgagggatgattcgttgcaggcaatttcctgccctagtggcagggagcaggcatgtgctttaaaatccttccttttaagaatgattccttgccctgcaaggttccttcaagttatttttttttttcgtctccaactgggggaaattgtaggactcaccaaaaaaaaaaaaaaaaaaaaaaaaaaaaaaaaaaatagaggcacaacacaagaagagtattacctaatcgcatgaagcataaatctgtgcgtcacctcctactttaataaattgctctttagtttcagaattggtgaatctaagtgggcacccaaagaagaaaaaaataacaattttccccttatctctgaatttctcttttgagctttttcgtagattatcgtgggtctctacaaagatttccttttccttctatttttaggttgttaaaaaaaagtcatactgtgtacttttttctcataatcctttatttgttatttaaagtataaataaatcatagatatttgcatacagcttagagcagagtaggtggggggttattttggtttatatcagagaaaatggaaataaaatagaaactcgatattgtttaaagacagcttaacagcattgtaaggttcataaaagcccaataagctattcttgatcttaaatcttaaatcgttggtgattttcatttagattttttttaatcaccaagaaggttgagatatgtctaacccgttatgtgagtttgaaacaaggtttgtgttctattttccattcctttggtctaaaattttattagacatttttcttagtgcaaaattaattgatcctggtggtgaggtggtgataaatcattgcaggtggggggaaattgatttttataccacctctcacttatttcaatcttagtggaattaactctgttaggttctgggggtgtttatgggtattataaaacatttacatcttgatgtattaaggtacttgagtggtttttagacattattaagggaattatgttaggattagtctggttatcaatttctgtatctggcacctagctaaggaaatggctgttttatcctcattagagccataaatagaattttattaactagcacgtaccaagtgccaaggctggtggtgaaaaccctttctgccttgaaggggagactgtagattcctgagcatgagacgttaaatgagtaagtctttgacaatctgtaaacagcttcctctgcagaagagtgccctgttgccttggagtttgaaaatactgcaggggataaagattccatggaaactttaaacaattgggactgatggatttaatccctctgatacgcttgtgtaagtctcactgaatacagatctgattatctattggccttggagaaggaacactgagactgtccatatggaagattattagggagaagagaaacataaacacactattaactattaaccatgctgtatatttgatctttactgaggctgttgatgtcagggcttggttttatttatctgaattttcttttgccatcaagattagttttaataggcttagacaaaacctggctgaaagattataaacaaaagataatgataaatggtaatgttcccacttggctgggatctggggagagaggaagggagattcataatagcttggtctaggtgaggattttttttttaatgatctggaagggaaagtaaattgcatgctaatgaaatttgcagacgatattaaattggaaggtgttgcaaataggagcgtggactggggacattacagaagcctatcctaagcaggttagaaatatgagcagaaaagattaaaacacgattcatcctagaaaagacagactaatacattttgggggtcgggaaagggggataccctgaatcttgcaatggaactgatgggaaaactcagaaggaaaaatagggaccagaggtagaggaagctacaggcagtctgcagggtggcattgtccaaagactctctgttggtccgtggcctgagtgggataagctgcatcgtcccagaatccaaggacagccgcctccctccgtcctcgcttctcacaacttctggggctgcctttctgctgtctctgtctttgttttcctctctcttcctttttttgttctttcatatctatcagctcacccacccctagtctgtagcatttatttctggtacctttagtaggagaaagatggagacagattggagacaagttggcaatgaagagtgaaaaagattaagggaaggggaggattgatacatgaggagggattaaaagcattgcatttgcatcatgcgtccacacagcatccagaggaggacataagcacacaggcacttagacaatgtaatgtcgcagtactcaggaaggtggccgtggcattatttagccccacgagccagaatatagccagaagtaattaagatagggaaattatataaccaaaattcattgcgggagagaatgagggttggaaacatcacggtttatgtgtttataccggtcattacataaaccagtcacatctgaagggctcacagctacactgaacaggggcttgcttaccaacagaaaatcccgaggacacatactacagagagtatgtggctatttccttttcctttgagattttttgttaatatatatgtctaggagcgtgctcagtctaacatctccaaagcagatctgcatgctagcaatgctagcaacatatgtgtgtgtgtgtgtatgtgtgtgtatatatatgtgtgtgtgtatatatgtatatatatatgtattacatatgtatgtatatgctatcaacatgcaggtctgctttggagatgttagactgagcaccctcctagacatctatgtccagtggaaagagcagtggagagcattgggctaacatgtattgagcagatggtgggggatgttagtaatgagatataaattgatactgtgcagccaactttcagaggtgcttactccatgcccggtgctaggacaagcaccttgcagatgtgatcccacggaattgtcaccataaccttcagagatgggcactgttattgatcccatttttcagaggaggaagatgcatctcagagagattatgcacaccgggaagtgttactctgcatagaagtaggggacagccaggattttccacaccaactccggagcccacgccttgtaataccacgttttgctggtgaatccctaattcagaaaattaccatgaatgtgtcatgggagaaaacagcttccaccgagggtgtgggccccaaagtgctttgttctggaattcattgcaggggagaggaagagacttcagggtaaaagaaacaggtgaggtgtggggacctttgcattattttgtgggagaacaccgagtaaaaaatagtggcggtggtgttggtagtaacggcaaaaacctcagttacttttgtgccgacgtaataacaacactattcataacattaacagttgaattttcagagcatttgctgagtgctgtggataatgttggtgctttctaagcatttttcacagactcctcttagaaagcctccaaggaaagtgaagattaggaggatgaagtaacttgcccaaaatcccgctgccactctgacttgatccaggttggaacccaggcaatttgacaaggctaccccactgcccgcctgagttgaatagagagaaaagtggaagaaaattaggccgtactgcacaccagagagacagaaacgggtgagcgtttgttattgggcaaaataaaaatgtaccactctatagagtggtatcatattaactgttcctgagtagagaaagaatattatctctgtaccatgagaagtaagagttctgaattaaaggtatcacctctaagttttaatttttgcagaagctctcttcatctgaattcacaagtattgactgtttcttgggaaaaatcccagattgcgcatagaccagcatgcttgatctctgagacagatggacatgctgtaatcttaaagtgaaaaatctaaggaaaattttacaaggtaatttttgtctccttttctgaacagcaagtttgacacctagctatggcttcagggccttctcattccttgtaccttgtctgttttttttttttttttttttttaattttactttaagttctgggatacgtgttcagagagagtgtgcaagtttgttacacagataaacatgtgccatggtggtttgctgcacctgtcaacctgtcatctaggtgttaagccctgcatgcattaggtatttgtcctaatgctctcccgcccattgcccaccacccccgacaggccccagtgtgtgatattcccctccctgtgtccgtgtgttcttattgttcaattcccacttatgagtgagaacatgtggtgtttcgttttctgttcctgtgttagtttgctgagaatgatggtttccagcttcatccatgtccctccaaaggacaggaactcattcctttttatactttgccccttcttttaagaggtctttaaacaatctcttagcttcctatcagcctgtaagtcttcagaaccaaggagagcaagctctgcacatcaacaaggtctaataatttcttgagcatttgttatttgccaactacttcattaagtactttgcatctattgtctcatttcattgatccttacaacctactcagttcatagttaagagaaccctcacttgaagagatgaagaactctgtgtaccattgtcaccctgttgcaaagtgactgagtctagatgtgctcctacatctgactctaaaacccttacgcaaccaaacatggtggcccctgcctgtaatcccagcccttggggaggccaaggcaggaggatcacttgagctcaggagtgggagactagtctgggtaacatagtgagactctgtctctacaaaaaagtgaaaaattagttgggcttggtgactgaggcctgtattcccagctacttgggaggctgaggtgggaggatcgcttgaaccccggaggttgagcctacagtgagctgtgatggcactctgtacccaacctggattacagagcaagacctcatctcaaaaaacaaaaacaaacaaataaaaattaaataatatccttaagcctagccattctttcctactacagtgaatgggctaaatttttatttattctgtttttatcccagtccttctcaagcagattctgccattgaagtggaaacattaacaatcagaggcctgttttcttggtgttatggcactggttgaacttcacgtagtatacataggtattacccagcctcaaaaacaagcaaaaattaaaaattctctccagaactcaggtgagtgaaaaatgggaaaggatgcctaactttatagatattgcaccagttcatccctttgtccctacgtgccgttagtatagtgacggagtttcacgttggcacccagagatccttccagaaggaatatgcacatacccgcagctacttttgtttttctttctttctttgcagtactctaattagaaattgtatatctgggaagtcctctgtggtttgacagtgagtggcagagatatggccaaattacctgcaatggcacttttaatttattttctactcctggcttgcctcacgctaaaccgactttgtttctgaagctgttcttatttggagggaacaagaaaaggaaggttttccaagtacaggagtgcaatgcagaaagttcctttttcgtgttgatcttagtgagctgtggatggtgctggaatggatggagagaaagggctttgcctgtgtagcttgtttttaacattattccataaagagcactgacaattaattagactcacacaacatctaggccattggtactgaagtggtagatggtaatcactttgccccatttttcctattatctacttagcagctacaaaatataattctgcttgcaatttatattctttttcatgctttggctttgctattggtactgaaattaaccagtttgctcgatctcttttcctatgccgtcaggacagctctggggtagttcagaaatcaattttcaatcagttcacacctgtacctaaaccaaatcccaatgatgcttgctggtaagctgccgatatttgaaagagtcactgtgctaatgaggccctcacatataatatctgcataaatggaagatgtcattcacaaccagtgttgaggacagcagcctgcagaactgcaggtgggtgggctgcgaagttgggataaatgtttcattcatttaatgccatttttatcacctgtttgcctgaggaagacgccatagcaacaatattttatagctttaaatacggtgttgatgttttctggagtcaggaaaagttgggtatacttacagaaagtggagaggtccttggtttctttcatgccactttgtaaagatgaacaactattcaatcacggtgcagaatacccctgaccttgtgaaatcaggggagaatggaaattattttcccttctcagtcattggtattcagctaggtggtttatgctaggttgtcttagaggtattgtgactccgttcacattatatacgagtgcatggagaacacattgttcttctcattaaaggcttattaactgcagtttgtgaaatggagtgaaaacaaatacgcttccaaatggctggcatgtttcttatcctcttgcctgacacagaaaaccccagggtatcggggaaattcacaggaacaagggcttcaaagaaacattcacagttagccagtcttaaaccgagagaggcaaggaaatcgcaggaatgttgatttcttcgttgttgtttcttttcagatacttactgtaggagtcaagaaaaatgaaaattaaaaataatggctaaaagtatggaagaatctgctcagtggccctggataggggagaaaagggggtcccgttaatttgcaaatttggaattccagatactaaatatgttaagcttagtaggaagtagattctgcataagcctccatgacaaaggcatttgattagaaatatgaaaagaacctcagaaaggaaagtttaagactatatctggaagtatgaattctgagggcgtgtgaactgaataaaaggagccatatacattgtggtagcaatgagtgcagtcttcatgctgacaggagtatttctaagtttatgggagccaaacaccctgaaatcccacatctctacatatggcaaaaggttttcatccctaaaacacctcttgggtgttgccgagtgctgattccatgcacaaggagagacgtggctgtttctttgcctcacagattctgagatgcataatagcttctgctttttgttctggtgagaggtttgctttttaggatgtaaatgaccatcacgttggcttgaatctgttccctgcttttcctgcctatccatccttgtatatcctgcaacctccatggctaaggacaatagggtctgttggtaacctcagaggagattggattgtaggtagactctgtttctctcctgtcctctttgtgactgctctagttgcagtggagacatcggatcccatccagaagcatcttatttacattgatggcccattaacacaacatgtaacccaagaaggaacgcaacaataaatcatcagtcacataattaaataaattgaggcttcttgtgtaaaagtgggataacacacagtcggcggagcgttatttagttcaagccaagctaatattgttagagcaaacattaaggcaggtgacgaggctgcatcaaaatattaattatacaccattttggcactgataataaatgttcacgtatggccctctttccaggagaaatgctgaaatatgtttcaaagcaacgctttgaataattcaataaattattggagtctcagtgggagagctcgactgacatgaaagtcatggcgtccatttttaaccccccatccctggtttcttctcttctccaaagggctctgaatgccaagtctccatgtgtcttaaatgtatcattaaagacacattcccagacagtgagaaatgcagtgtcgataacttgggaagagttcagaaatcttgactcagatgtgtgagaacttttaaaatcacagatcttggcatgaggccaagtctgtgtcctacagcctggctaccttggctgagttgctcaaagtctctgagcatccctctcctccttcatacattggaagtactagtacctaccttgcaagattgttgcaaggaatggaaatgagatatgtgctacccttagaatattaagtttggggagttctggaagatagcagtcgtctccttaataagtgtggttgttactaactatttttacagatctgacttctccatagccttgcctggactccgagcagaaggttactgtgtgttcttttgtttacccactggactggagaatgatccaacattgctctaaaacaggatactgcacaggctcacctgggtagcagattcattcagcctagccagtaggtctttatacaaggaagactagacttggaagaacttgataatcctaaataatattatttatttctattccttctctatctccctgcactagaatgcaacatctgtaagaacaaggattacatttttcccatacatggcaatatttgctcagcaactatatagtggtagagttgacttgaaggatatatttaaaggaatcaatcaagagtgaattagttggggttttaggtgagtctgaaactcaaatgcctacagagatctacagattttgagttgggctgggtataaaatgataagggaacagcatagttcatggcaaaccaaagaaggcacacctcacccaagggtattcagagtcatttgatcattaccaacgacaggcacaaaaaactccatttgaatgcaaattcagcctccaagaatgaactttgtgaacttactgttttcaagttgaagtgggttaggggaacacagtgactaatgactatttaaaatggccaacgagtgccaccaaaaatagtcatggtgttgccagctctatcttgtctatttgttcggacttgaagtgatcttcgttgttttcccagtaggaaacaaacttgctaagaatcctgtattatcattggtgtttgccaatatgatatttattaaattagccaatggatgtgttttgaggacatgtcatgtgtcaaagatgatgctaggtgttagggctgcaataccaaatactagattattcacaggttcatgaggctcatctagcatcattctcacaactgctaacacagggcagtgcctgattcatagttagactttagtaaacatttgatgaatgactaaatgtgtaatcagaacaggaaagtgaaaatcttgcagatcgccagctcagagtatgtatgcatatatacataaaagcacacacacatataagcatacatatatgtgatacatatgaaatggcatattaagaccattctccatttatcgtcatctgattgtctagaattaagaacatttacctatatgtggaggaactccaaaattattatgctattgtttctaatctagaaagatctttaggaaatactggtagaacttcacatcttcagataagcttttcagtctagcttacccatgctttcctgtcctaaaattttctaagttttgatatcttgctaaagaaaaaatgaacagtgttaagcgttggtgcattttgcgtacttcaaccttttctgtctataaacaagcatctgtaaggcacctggaactctgctaacatggctcacatgttccactttgtgacttgatgtaactcttagctgcgtgcagcatccaggtgagatgtgaagctctcattcagtttacaaacagtaaaattactgtgtcttaataatgtatctctatgttgttgaaatttatggagaaaatgtttgtggtcaacaatgcttatcagaatggtgtgaacggtttttttatagcgatgtttatcaagttatgttgtgcatatgagtcatgtagagttgatgcttgggaaatcttgttaaaagaattgcttaggagatcttgttcaaatatagattcagatttggaagttctgggttagagcctgagattctgcttttctgctgaactgcaagtgatgggatgctaccaagtcatggaccacactttgggtagcaaggattttaaacaaataaggtccatgcatcatacatactattgtacatacatgattttgtgacaaaccacatacatgtcctatgctagatactgcgtcatttttgttatctccagtttacaggctgaaaacctgaaactcagtcaggtgagagctgttgtctgagttgcacttctgggaaactgcaaaattgagatttaaacccaagaactctgacttcgagcacatgttgttaatgtccctgtatgttgcttactgtctctgctggtacagctgaagcaaggtcttaggtctctaagcagatagcacctgaatacgcctgtatgcctctgtgcttggctgcattgtagagtgtgtttttagtaatacctgcttggggtactactgaattgaatagggttggaattctggatctaaggtctagtggaaccaacagcgaattctggacattagttctcaaggcaatgcttctcattgagatgctgtcacccccaggagggtatagaccaacttctttagctccagtggtgtgagaagagtaagcagggattgagtgtgtctccagaatctgaacagaatgagcttttatcatttttaccaactatgcccttgatttgtgttcaagatagagaataacttttggagggggttatttctggaataaaaagggaatttacttatctgtttagtgatggggatgatctttcctccaaatcacaccgtggaacagtctttgatcagtagaatttttctttgcagatgtcacagaggtattcgttccttgacatttttggaagtgtggatataggatggaaaggtttggaagggtggaggtaggatggaagggtggatataggtgttattctttgcaccatcaatctacctgtgactggtgatgcaaagtataatgcccttccctcccaaaagtgtaccctttgcagaatcagtaggaagtgaggaagtaactccttttaacttggatgttagcagtcatcatcctaatcattccctattttaatcacagaaataaaaggaagaaaatcattcttgagtcggctaatgctatgttacagaaccatagctattcattggtaatagctggaagactgttctcttatgcccttttaattgagtgtctttccgtcctctagctgtccaatatctgtttaatccacaaacaagactaattttgactcaaaacatagctggccctagtacaagaagatgcattgagcaataggaattataaaatgaaaaggtaaggatggttgcatcctggggggaaaatgccttcccaggcaatttgagcaaacaaaataatgcaaatgtcttctgaatgtagtaaggagttaaggccatcagtaaaagagagcaaattgaatgaataatacaaagaatcatccctcagtaagagaataatgatttcatgaagcagtgtagaaagaggagggagagtagagaaatctgaatgcctttgatagttgagaatgaaatggaaatgtaacagcttcacaaggtgaatatggagaaggggtaggagaagaggaaacaagatcattagagataacccgtggttttaagcaaaatgaggggaagacatttagaaatttgtaaaattgtgaccacagcattttttgacagtggaggaggaggggtatgtagcttggatcgttgtatttagaaactaccttttttatgaattttgctgcattacctgaaagtgagcattagttacttgtataataagcaccaaaatagattgttgtgagcatagcagtgatgtccgtgtgaataacatgtgcactaagaacgaaggtgaatatggagaaggggtaagaaaagaggaaacaagatcattagaggtaacctgtggttttaaggaaaatgaggggaagacatttagaaatttgtaaaattgtgaccatagcatttttggacagtggaggaggaggggtatgtagcttggatcgttgtatttagaaactaccttttttatgaattttgctgcattacctgaaagtgagcatcagtcacttgtataataagcagcaacgtagattgtcatgaggcatagcagtgatgtccgtgtgaataacatgtggagggttagataattgtatgtggaaaagaaagggacatggacaacatagcggtcatcctattgtgtctaaagtgaatttagcacacatgggcgaaaaaggaaattttacgtatcaggtgttcagtgaatattggaggtgtttgttgtggtggtggtagtttttactattctgtaaaatgcacagtttcaaataaaggatattgttatttccactttaaaatacataagaaactaagtaagttcttcttgataccagaaaggggtccaaatccagacccctagagagtgttcttggatctcaggcaagaaagaattcagggtgagtctataaagtgaaagcaagtttattaagagagtagaggaataaaagaatggctactccatagagagagcatccccaagggctgctggttgcctatttttgtggttatttcttgatgatatgccaaacaaggggtgtattattcaggcctcccctttttagaccatatagggtaacttgctgatgttgccatggcatctgtaaactgtcatggcactgctgggagtacagcagtggtcactctgattgccatcttggttttggtgggttttggccaccttctccactgcaacctgttttatcagcaaggtcttcttgacctgtattttgtgccaacctcttatctcagcctgtgaattagaattccttaaccatctgggaatgcagcccagtaggtctcagcctcattttactccgctgctattcaagatggagttgctctgattcaaacacctctgacattcttgctgagagccgtgagttctcttgctggggttagatgatatgagatggtggaggccgcagggacggaattgtttcttttctagatctcttccttagtttactttctttcttccctttgtaaaaggaaaataaatcttgggacctcaaactcactaagccaaagggaaaagtcaagctgggaactggttcatgcaaacctgcctcctgtttttcttcctcggtgtaatggctacaaagatggaaagctacatacctccctcacctcttgcccgcctgaggcaaatgcatatccaatggcatcctttgccgtattgtctacattatcttatgtaaacatgcagattagctgagacagacaaaggcataaataattattttctcttatcctccaacatgaaaattgtatacttctcttgatcttgccctttcccctttaaatattgaaaccttgaaaatcatcttcttagaaaggtattagacctgtctcccaggcacatgttcttaactttggcaagtaaatctaagatgattgagacttgccttggtcattttccttgattaacatgtctttataatctttcaaaagttatagactctgtgttggaatgaatgtgtgtgtgtgtgtgtgtgtgtacatacttgtgtgtgtgtagtttgggtctgtgttgtacaggagtaaaaaaaatggctttatgtccactgtcagtgaatactgctgtgcctttgcactttgactttaaacaagagaaggtgtaattgataaagaaactagaagccaggcatggtggcatgcagctgaagtcctagctacttgggaggatgagttgggaggaccacttgagcccaagaggtcaaggctgcagtaagccatgatcacaccactgcactctagcctgggtaagaaagtgagatgccatctctaaaaataaaatagaaaaagaagctgaatttttccaataaagtcccacatccaactgtctggtggaactaccaccaatggcttctcattggtggaaacagttccacagattttttttttttttttaagaaaaacctaattgcatgtgaatttttctcagacaaaagtagttctaagagtttaccaagaaattaaagttcttcaataattcagtgtcaaatacatacgtttgaatactgaaagcagcctcttaatatccatcttcttattggctttttgtcttgctttgccttgtagatttttagataacgtctaaaggaaaacaacaaaatggttgagggggaacctcatggagtcaatttgtttttcactgtggaaaatttctgtagtcagactgatttttgctccttctaggcgaattgttatatttgcacacattgtcaaaaagtcattgaactatctattgctggtgactgcacacatccctgttaccagctctgtagtcctctgggtttgggtgtaaaaagagttgcctgaaataaatagttaactgaaactcagcctgggagctacatttctgagcacttccgttttctacttcttacaaaatacagttcaaaaaattctagactgacattcaaagtactttttcatctggctccagcctgtttcaaccttaagtacacacagtgatataccgtaggctaggacattgttgtccccagggtacttacaatttccttcctgtcttcatatctttcccccacctggaggaatgtctaccccctttagctccaagtcttatctactcctcatagccacactcagatagtagtgattaatattcatatatattcactatgtgctttacatatgcagaatctttcattttcatagtaccctattaagtgggtaatattgtcattttatagatgggggaaatgagaaccagagaggttaagtaatgtgtaccaaatcacagagctaagaaatattggatcaggggtataaacctagacactctggcttcaaagtctgcctccttaagtattataccagacagcctctcaatacttacatctgccatgcaactgttcttcatcttctccagcaaaatttaagctcgctttttccctcaaatattcctatcgctctgcccgggctcatcattttctgttttgaatatttgttattcattatgatgagatgaatgcatagcctgtctgccaggtccttggataagctcttgggatgcaaagtcaaaccattttctcccttcagggaactgataatctaggtttggagaggggcaagcaataaacatctgtgaggtagatgattatgtgataccttatgccgtatcttagtgtcttttaatagaggtgtgaatacaagatcatagaaacatagggaagaggggctagttcagccctcgtcgcctggtatgggcaggaagactctactgagaaaaggtacttgatctgaactttgaagcatgaatgtaattttcctaaccagagggtccaggaataggattccagtccaaggaagtgggatgaataaaacctcaaatacactctcttcatatgccaatgttcctggatgggtttacaccatctcagaattccagggtgagcgggggggtggtggaaatagacgaattgcaggaatttttactgtaagagtaaaggaaaaacatttcagtgaataaaataaagatgtaatgtttgccttatcctctaaatatttaaaccagagatcaaaaagtcaaatttcaactaggtgtggtggtatgaacctggagtcccagctactcaggaggctgagacaggaggattgcttgagcctaggagttccaggctgcagtgagctatgctggtgccactgcactccagcctgagcgacagagtgagaccctgtctctaaagaaaacaaaaatagattttctgcatggggccaaacaggaaaagggaaatgtctaaaggcaatagagatgggtggggcctggggagagcacagactcttcctgaaggaagcatcagcttgtaagcttattagacttggagacacaaaaatatggtcccagtatggttagatgagttggatttgtagatatttaatgttgattgttaagccctggtaactttgcgtaaattgttttaagcagtgagtggttcacatattttatatagatgggccacttagataatctcacttgcagtttgtggtctgtgatttagaccaaacaggcttagctcagagtttctgtgaaacaggtaacactaagtatgaaggtgcctgcttgtagaccaagtctaatccgtcagcaattcctgagtgcctacttgatgctgagccctctgtgagatcctatagagtctactaaagtaactggatgatgaagagggctcttaggttaatgcaagtttagaaaattgtgttttggcaattggcacataaataccaggttgtccttttgatatcactctgttaaaatgtataattctggaaatgttcctcttgttttgagtctctgatggagaaaataatgagtagcaacagaatgcatgtaaataggaggaatgtgctgtggtgctgcacatttacaccgttccctatcatttaaggagaccagctgataaaaaaagatacatgtttatttcgtttgttccttccctaaccccaatttgctgtgttattcttccggattttcaggaggaatcggcataggatagtaatcagcattgttttcaccgtgaccatgctttttccactatactctctttctcccactctctctcctccaagtccatttctggcaaagagctcttaagcagtgagtttttttttttttttttttttttttttgagacggggtatctctctgtcggagtctctctccatcgccaggctggagtgcagtggtgcgatctcagcttactgcaaactctgcctcctaggttcaagtgattgtcgtgcctcagcctcccaagtagctgggattacaggcatgcaccaccacacccagcaaattgttttgtatttttagtagaggcgaggtttcatcatgttggccaggatggtctcgatcccttgaccttgtgatctgtccaccttggcctcccaaagtgctgggattacaggcataagccaccgtgcctggccccttaagtgtgtctttatagtagaggtttgtatgctcagccttccagcctgtggagctgtgtgctattaccaagttttactctctgagtacatagcctgtagttgggtttgaatattaagtgtcaaattccaatacaccaatgagagatttgaagcaaccagcaggtagcttctacatccctaaaagctgcagagcgctgtctgtgtttatgagcggtctcatttcacacatgtccaatgactggaatgaagctggtgatccagtgtgtgatgctgaaggtaccattacctgcagctgtcctctttcctgaaatgaggaggggacaggggcaatggctcaggaggaaaacgtgcagagcccgctgttcacaaatgtgaaggttactccagagagcgccgggagcgatttgtcagctttgtttgcaaagagatagggagtgaaggattgtgatccttggcaccgataatgtcccctgggccacaaactaatccagcaggacacctgatgtaacacagctattttattcacatatgtctgtatggttatcatagagggcaggaatggaataacaaggcttaggagataatcatcaaacaacgtctccctcttctgtaaaggaagctgagcccaggatcttcatcctttcagccgtacaagcagttgttcttctcacagacatttatcgagcattttgctacatgccttgggcacggttggaaggtccctcacttcgcagagagacctcatccatggatttagtcactcacacgctcatccattccccagacactgcttatgaccttggtgccaagttcagtgctagattttcaaagaagaaaggggataaacatttggctccggaagcagaatcctggctttattactaaaaagctgggtgatcttttctctagcagcctcactatacttatctggaaaatgggtataaaggcagtttcacctcataggtggctgttacgattaagcggggaggggatgtacttttttttttttttcgaggtggagtctcgctctgtcgcccaggccggagtgcaatggcgggatctcggctcactgcaagctccgcctcccgggttcaggccattctcctgcctcagcctcccgtgtagctgggactacaggcgtccaccaccacacctggctaatcttttatatttttagtagagacgcggtttcaccgtgttagctgggatggtctcgatctcctgaccttgtgatccacctgcctcggcctcccaaagtgctgggattacagacgtgagccaccgtacccagcctgtgtattttaagaatacttagcatatggcatggcactgttagtgatcagatccacatgagtttacttgccagaggaagtccatgcatgtgttaccacaccgaggtaccggtacagaccccaagagagggttcttggatcttgtgcaagaaagaattcaggatgagtctgcagagtaaagtgaaagcctgtttattaggaaattaaaggaataaagaatggttactcgatggagaaagtagccccaagggctactggttgcccatttttatggttacttcttgatgatatgttaaacaaggggtgggttattcatgcctcccctttttagaccacagagggtaacttcctaatgttgccatggcatttataaactgtcatggtgctggtgggagtgtagcggtgaggaccaccagaagtcagtgttgtcgccatcttcgttttggtaggttttggccggctttcttactacaacctattttatcagcaagatctttatgacctgtatcttgtgccaacctcctatctcatcctctgacttagaatgccttaactgtctgggaatgcagcccagtaggtctcagcctcattttacccagcccatattcaagatggagttgctctggttcacacgcctctgacacatggatcacaatttggagagcacggataggctctcatggatctgctgtttcactgtggcttaaatcccagcctctacttactggtggccttagcattactgtgaccttgggcattttataaaatgcctgtgaatgcctctgaaccgagtttcctgatctgtaaaatgagaatagtggtgatttgtacagtagtcagggaaatactgggtagaagagggcagttccttggcaaaggcttcaccctcaagcctggatacttgtggccttaaatagcaacagacattcctgttgctttttggcccaccacacccccctatcctatacccatataaaccccaaacacccagttccagaaggagatgaagagacaaacagaagggcagaagaatggcagaatggcatggcagaaagaagagagggagcatctgaacgctgagaggagttcagctggggacagtcagagaggagattggccactgggtggcgaaacgccagaggaagatcatcttcccactccatcccctttccagctccccatctatccagatgagagccacctccaccgctcaataaaacacctgcattcactatccttcaattctgtgtgtgacccagttctttcggggtgctggagaagagctcaggatgcagaaagctgttgcactggtcctctgcatttgcaaataggcagagggtctgctgtgcttgttaacacttaagccatccgtggatggcaaggctaaaagagcacactgtaacacacgcccagttgggctcctgcagctgtctgtcatcatgctccacctcctgtaaggggtttgagcagtggcagcaattgaagagatgagccacacccctgtctcatgtcctgcgagggggtcagggaactctcttgtttcaatggtagtgtctgtgaatgcagttctactgcacagggtgctccatagacaccctggcttgtttttgctttccatcacactgatgtgttagtcatacctcacacagtcactcacagctccccaagtatatcccattgttatgcacttcatgtacacaatgcatccctaagacataaaaaacaatcatcaatttatttgacaaagtgtgctttgtttataagttttcacaataatcagagagtgactgctggtaagccttgatttcttttcaaattcagttgaacgcagctgtaaagtgcctgaactttgcctttagctaagcagatcctaatgggttcagttagcattgtatatgcatgtgattgaccaaaaccttccttctgggttggcaacagcgctcattaaaaagtgaaaatacccttagtgttaatttaccaagcagtgttcgagaatgacaagccatctcaagagactgttttccaaaggttagcttttgaaattaaacaaattatggtgagtttacatatttgttggatgcaagtgcaatctgatatttaaatggatcatgccaccctttggatgttcatggaaaatttggaattatagcctattttggttttttgatgatctgacattcctcatgtggtgcttgagaggttaagaacccagaggggagccttggtaggcactggtattcattggtgacagtggatggaaaagaatatcaggatcttgacccctttcctcgtgctatttctgcccttgtctctgatacttcatctctgttcccaggtaaaaggcatctgccaattgcaacccacagtcttgtttgcaaggaaagtaaccccaagcaatgcagcagctggtggtaacattagaatgaaaggggcaggctgaatactagcaccatgggaaagaaaatgcaagtgtccgatgcaggggccttagccccacaaactcatctgaaacagtggacccttttcctatttttgctcttccgtctcttcctcagaggatgataaataatgtgataaccatgttatttactgacatcattgttaaatggctaaagttgagcaggcagatctaattcttttaaattcatcaattcatgtaattctaaaaatagcgttttgagatgagtggcagtatcatgacttccatattacgggtgtaaagattgaagctcagagaggtcgagtaacttgcccaaggtcacagcgccagcacatggtgaagcgcacgtaagccaccagccagagtgatttcagagacctcattttactctaccttcccaagaccccagcgtcatcgtcactctcacatccaggtcactctctaccatttggccagtttttctcctaaaatatggtcagaacaagtcattccccttctcagagatccctaatggatccttaatgactacctgccaaagcctaaactcagttatttgcagtggccaaaagcgtggactctggcgtctgctgggtctcagttaaaggcgtggctgtccttatcactaagggatctttgggaaacaagtctgtcggggttcagtttcctcaatggtaaaaaaatggcattaaaaacaccaacctcagatggcttcactagaagcccacaccctcgttttaacacaatatacctctgtaacaaacctgcttgtgtgcccccagaacctacagttaaaataaatctaacaaaagcacctacctaactcacatgtacaatgggataccattcagcttcaaaagacaaggacattctgtcatttgtgacaacatggttgaacctggaggtcattatgttaagtaaaataagccaggcacaggggaacaaatactgcattatctcacttatatgaggaatctaaaaaagtcaaactcatagaaacagagagtagaatggtgtttaccagaggctggtgagaggggaggaaatggggagatgatcaaaggatacaacatttcaattagacagaagaaataaattcaagagacctatggtacaactatagttagtaacaatgtatatacttgaatatcactaaaagagtacgttttaagtgttctcaccacaaaaaagataagtatacacatgttaattagcttgatttagccattccacagtgtatacatatttcaaaacatcatgttgtacaccataaatatacacaatttttgtcaacttaaagaataaaaagaaatccctccgccaacccaactacctacctcacaaagttattagcgagacttgcacctgtggtacatataaagtatttagcggagtactcattaaattcgtactgttgttaggttggactcatgaagcctccttcatctagtttcatctttccaatttccctcaatatctttcccacattctggctccggaaaactattcctgattccctcatatggcatggggcttcgtgcatctagcttgtagccctactctttcattaagtgacagtgttttcaatccatgcattatcacagttgccacttttaccaagtccatttactccaccaccacctcccaagtcaggatacattgctcttcagtttttctgctgggaatcttgttttgctgtgccttctattagctattattaatgtgagcttgtttagaaaatggaatgccccatttatctctgaatccctaactgtacctggcatcatgctttgatggttttcacaaagtgggaactcagaaagtgccaaatggattaatgagtggatgtgcacattaaaatgaacacaagtaacttacattatgttcctttgaaaaacatttatttcctatgagttgtcattgaaaaaaaaatccttgaggatcagaaacagaacctggaaactttggaatgtagatttttttctttgcttctttaaattgtagacttatttaaatctctacatatttcaaatctaaaagaaattatgcacaaccagactctaaatccatgtggaataattcagtatttcatatacatgagttctgtatttttgatgggtgtcacatgccaaagaatgtagactatggctagaaattaagtgggcttttgtttgtttgtttgtttgtttttccaattgcctagataggattttgccttattaggattaaagactgctttcttattaagcgatgcaggtctcattgaaataagtacctttatgaaaatgatgcttttctgatttttgtgaaagattgaagcattttagggtaacttggaacattatgagatctagtttccggagatgtgagtaaaattaactccatgttgtgaagattttcaaatgaaaaaaatattacagaaaacgtttagggaaggctacccgtgtctgaggaggtgtgtgggaaatctctataattttctctttattttgctgtgaacccaaaactactcttaaaaaaaggaaaattttataaaaacagtttaggggagtgcctagaacttagcaaatgctctgtaacttaatgctcaataaatgctagaatatgcttctactagatctggacccaaaacatgaggctttacctattaaaagttaagaatatttatcagaattatatgcaagcatttcgtgaagcatcagatatgcagtatttcatttaatccttacggggatccggtagcacaggtagtccagccacttggcagaagaacatcctgaggttccaaggggtctgtaaatgccccaatatcaaactcagggaaaaatcagaaaccgagctttgtttactgcaggttttcagttcttaccactatatgttactgtccgtcatgacaagaccggagatgcaaatatttttatctcaaaacttcctacatgtcctgtggcttcatccacaatgtttatttcttacctgaaatcatgctatgaagaaagtattgcccaaaacacatttggatgaggtggcatattagatacataacttttgatggttacctgaggtggcccctgaacatttcgcaaacctttcatgatctcactccagttttatgactttcctttctcccacacggagatgctgagtgctgtattcatctttctgcctcgctatttttccttcatttccttcattgtctgcttttctggagcattgtaccaaatggcttggttgttctttgctgaacatgaaggactgactatcaggaattttcttttgtcttctggaattcactggctttttaaaaagtcagatatccccttcgactagatggattttatgttttgtttaatttttttcttcttgtgggtaggaatgtgtcatactgagaggcacgtagtatatctatcttggtattgacagcgttgaaccatatgtacacttttgaggtatctttgctcttaagcttgttgattttcctcttctgaggatgcatacgaaccaggtcatctgttgcaattaaaaagaaagaacatttttaaaacaagaaggtctaatctctttcttgtgcaaacaggagactgaggcccagagagagttaaataacctaatcaagaccaaatggctggtaattagcagacatgagactaaacttatgccccttttagtgattcatttagaaaaatatatttttaagacatttttcagaatactaagggagggtttttaggtataaagaatgtagtgaatgcatctttgaaaagtagcataaatgacttgaaaaaatgatattatcagtgaaggcacttcacatattttatgtgggggtgtctctcatacttggggcagaccccactgccattgattctgttgggatatgatgcttgaggttcttattcttaaagataactgcaccaagtttgccttgatcgttttactatttccttgagattactttcttgagatgatgagaccagcttgaattttcattgtagttgtgagacctttctcaggttgaaatgaattctgataagctgattatctctctgaagaaaatatgatgtccacatttcatagcttagttccgatcacttcagtgccattttcgttctgagacatcttcccgggtctgaattaaataagataataaggtgctctggagtccagtacgtattaaatagatttttttttttttaaaaaatcgaggcctacagagtggaggatggctttctttatggtgtattttctttctccatgttgaagtaggtagcagctagctagtttctttttctttatagagcaatgagttatgaagctcaaaaataaagtgttctcagtggtgtaaataaagcagtagtctgagtaaatatatcacactatgtactgagggtttgctttttgcgttattttgtctctttcttttccttctccgctctggtccagtttatgccattgtgtattgttgacacattaatcttggtaatagaaatggaaagctacttttcattgagaaatagattcaaaggaaaagatgattaatgggctgggcacagtggctcatgcctgtaatcccagcactttgggaggccgaggagggtggatcatgaggtcacgagtttgagaccggtctggctaacatggtgaaaccctgtcttttttttttttttttttttttttgagatggagtctcactgtgtcaccaatgctggagtgcaatggcgctatctcagctcactgcaacctccccctcctgggttcaagtgattctcttgcctcagcctcctgagtggctgggattacaggcacgcactaccatgcctggctaatttttgtatttttagtagaatcggggtttcaccatgttgatcaggctcgtcttgaactcctgacctcatgatctgcctgcctgggcctcccaaagtgctgggattacaggtgtgagccactgcgcccagcccaaaccccatcttcactaaaatacaaaaattacccaggcgtggtggcaggtgcctgtagtcccggctattcaggaggctgaggaaggaggatcacttgaacccaagaggcggagattgcagtgagccgagatcatgccattgcacttcagcctgggaaatacagtgagagtccatctcaaaaaaaagaaagataattaatgaacagaagttccatgcattcccaatgatgtgtttttttatcctggctctataaatctgtctgcattgcagcctcttgtgagctcccagattactgtatccctcctccgtctcacctccatggaactggtggatttagctccaaagctacctggtattgctaacggaggaggaggacacttagaatcttgaggactatcttccctacagagccgtatgcctgaggaggggagacgaatggctgggaatgatctactcagaggggagacgttacttagaattgctgtgttggtgaccagcatggtggtgcttgcctgtaatcccagcactttgggaggtggcagcaagcggatcacttgatgccaggagttcaagaccagcctggccaacatggtgaaaccctgtctctctaccaaaaatacaaaaactagccaggtgcggtggtgcacgcctgtggtgccagctactcaggaggctgaggccggagaagggaggtggaaattgcagtgagcccacatcatgccactgactatactccagactgggtgacacagtgagaccctgtctcaaaaaaaaaaaaaaaaaaaaggaattcctatatctgagagacgttgctttgtaaacctgttgcacaatttctctctccaatgacaacaatcaacagaactagtgagatgatggataataaccaaagtgaatctgttgggaaggggtgatgcatggtagaggagcttcctgtgtgtgtgtgagagctaatcacagccccatggcacgtctgagctcctttcttgtaaaagcacatcaatcagtgtctttctcgggttatcccaaatccttccacgggtagtcataagcatgtgatgtctacttgggatggaagcattctcattgagagcaaatatagcacaactgccattcagaccacagttcaagttgtggcttctcagtgagaacacgtaccaatactaaccctctctgaacatcatgcttaatctgtgaattggagataatgatgcccagggcatagggatgtcagtgcaatgctgcatgcaaattgtttatcagagtgcatgacacagagttaacatgagatgctcctcctcctccttctttttcctgttaatttttattattttcttgctattggcattgtctttatttacacatactcacatgcatatgtctttatcagtcccagatagatatttactgagttcatttaaatcgcaataatttccatcacttttacctgtgtctcaaggccctcttcagcttgggaggacttcaatatgactcaagtaggtacagctttttaaacacatactgtagtcatactcttagctttttttttttcctgtattacctcatttgatcatggggagaatactgtaaaagagtactttttatttccacctcgtgcattggataattgtggccagagatggacagtaactcacccaaggtcaagcaactagcaaatgctggagctgccagttgcaccaagtgggtatgacttccaagttcaaagctctttcttcacgtatgcacttgcctctgaatatcatggtctgtcctctaactgaccccttaggagctggacatgaggtaggtaggaagttgagcttcaagaaggagctgtcagtgcagggtggtccatgaaagcccctgggtctcagatggcagagaaacatgtggtttctttctagaattattcactccttcactgagcccatatttaaagcgcgttggttttgctctaggcactctgttgagtgcagagtatttggtggggtgcaaaaccctccatgtctgagtcctcaggcagcattcagcctggtgggagagacaggtactaatcaaatgcttatgttttcctgtatagttatagctgagataaatgcaatgacaagggaacctgtcctagatttgctgcagaaaccaatcaaaggaggctttgctagggaggcagtatttgagctgagagttgaatcatggatggaaaccacacaggggatctcctttcccttcaagccctgctgctggagccgggcaagttgcaggggaccctgagggctctcagttatcgctcatgcatcgaaaggaatggaactttctgcattagatttctgcagagattagcacttcttttacgtcagaggcatttttatgtaagaagtctactgatttcttcatggatgaaatcctttggccttcttaatagcacgtgtgtgccaggccagctccagaagctgatagattcaggtgaactcagttcatgtgaactcaggagcatttgctgagaagcctgattcctcttggtcagaagaactcactggccgtttctacttagatgggaaggagcattttcatctcccaaacaattttgtgcaatgcctgtaatcagccagcagttgccgtccatttctgcctgtcttttatcattgaacctaaaagaatctgtctgcaggaattaaaagttgtcgttttctctgatatactatgccttgcactcagtacctctaaggaaatgtcacagaccccccaaaactcccccatttaagtggtggaaacatggaattctctagtttcatgatgggattggtaaaggaagatatagctactttgtgaacttggtgcttataccttctctccttttgctagacatgaacctgaaggcaccacccaaaaagtcaaactagacaacatctctatttttaaaaaaggagaggcagactaaacattacatcagcgtaaggacttcagagtcacacagaactggatttgcattctggctttgctgttgactagtggtaaaacctgcagcaagttctttcagattcgtaaacgcccccctaggtcatcctcaaaagagaaataatggtggttgtgcttagagagacttctgcaagtaaagtgcctagtacatggtaaatacttggtgttggatagtaatcattattgccgggcaggaggctgaggcaggagaatggtgtgaacccgggaggcggagcttgcagtgagccaagatcgcgcactgcactctagcctgggtgacagagagagactcatcttaaaaataaaaaaaacatcatcattatagctattaatattgtccaatactaaatggataagaaataaattatttcttatttatactaaattatttctttctaagtctaattgatctaaatacatatgtaaataatagtcattatataatatcatttaatatattaagtcattatataatatcatttaataatatataatagagaaaatgatataacaatctgatacataatgagttttaattatatatttttataaatgatatttatgatttatatctttagattattaatatttatgtatttttataaatgataatcatttatgttatttatatatttctctattttgataattatttccatattttatacatgatgattgtttatattatttatatgtttatttagattgttatttacatatttgtatcagtgataattatgttatttatatgtttatttggattattacttttatatttctataaatgataatttatattatttatatatttatttggattatttacatatttttataaattataatcatatattcatttaggttgttatttacatattataaactgtaatcatttatatattcgcttaggttgttatttacatatttttataaatgatatttatgttatttatataagtttctttggattgttatttacatattttataatcatttattcatttatttatttaggttattatttacatacttttataaatgataatttctattatttactgagttatttggaatgtcatttacatacttttataaattataataatttacattgtgtatttatctatttggatggttattatttgcacatcctataaatgatcatcatctgttatttccatatttatttatttggattgtgattattatttgcttattccttatgtagatccttgtggccctgtgtgtgaatccatgttcttgagcttgcaagccatgtgttggatcatctgttttgcttcgcctttgtggcatgaaagcaatcttagataacacttacataaatgaatgcacatgactgcatctgagagaaacttttttacataaaaatactggctgtgtgttgacttgactggtggaccctagtttgctgagtgacagggttgcctgcacttgaacatcctgctcgtgtggctctgagtagttcttacctggatgacttagtcaccaaaatgtatgttgtaagtaaaagaagccccttggagctaggctgagccagagaggcagttttttggggaaatgcattggtgtcacgtttggtatgcattggatgcagaaattgcatccctgatttatgcgaaaagcaggctattcgaccaggtatcaggagttgtggaataagagatgcaaatgctgtctggaacagcaggtgccattcttagaaaaatagatatgggggatgtagaggaacaccaaaagtatttcccaactatcactcctaaaacaactttgctcagtagctgtctccccctgccactttttaaactctacagcacattttaagtgccttgtccgagcctggccagagggacgtctctctgcttctacaagaataccttgatgatatttcccagctgaaaagacttacctctctcctctcaccctatacccaggaagttttaattttatggagattgaaataatcaggtctcatgtgtatatttcctttcaaaccactgcgttcgcctgttttgaattcaatggcctgtcttatgtactcggtggagaaataatataaacaaaccttgaaatttccctggagttcagcttcccttttcatactgggtctagctaaagtttggagccaactaaaaagagcctcattgccttacacacaccctgttatctctggcgggttcaaatgcaatttctctgagaaggctgtggtacctctgctctctctggccttgaatctgagcgtctaaggatttctttggagtacacacagttgcatccttctgacagacagtgcaaattaaaagatccggcgcggcccaggaaccagggacccaaacttgccccttgggttttcatttacagttaggcactgcagacacaattattgctgacagggaagcggagctggtggcagagtgcgcctgacaggaggctcatgccagcccataattgggaggattatttttaatcagaacataccctacagcccaaacattagaaatctcctgtaaggccaagacaggaaattaaacacaccaacaataaggctcaaagggaggcggtgtgtggggtgtaatattgttagtctctcggaggtccctagagcttcggggagaagtttgcttccctacagagggaggctgggaggaacagaagcagacacagagactatacctgagcccttgttgaatgggcaaatgcagccaaattaaatgcagcagaaacactaattgcatttaagtgcaatgtgtaatgcgtttgtttcttgcaaatgcaatgacgcttattgactttagtagtagtagtagcattttgagacagagtctcgctgtgtcgcccaggctggagtgcagtggcacgatctcagctcactgcaacctctgttcaagtgattctcctgcctcagcctcccgaggagctgggaatataggtgcctgccaccacgcccagctaatttttgtatttttagtagggatggggtttcaccatattggtcaggctggtctcgaacttctgacctcgtgatccgcccacctcggcctacgaaagtgctgggattacaggcgtgagccaccacacccagccgcttattgcctttaagcagcataagccacatgtaaaccttggaatagcggatacaattgtatttcatcagtaagagaagagcctcactggttccttatttttaggaatcttcagtgagcacttactacgtggcaggtgctgtgatggcttatgatactaggctatgctgaaagtcatctggatgatcttattgccttggcaaaattttgcacagcacagtaaaactttgtttattaaaaggattgttgttgaagaagtaggcgtagcgcttggctgtttggctccagtaatatttatttagtagtagtgccaggtaatttagctgtagtgtcctcacatcaaccctctgaggtgggcattattatacccattctatggacaaaaaaactgaagctccaagcggtcaagcagcttgcccagaactaataagataactgactttgaaaccaaatctgtgtccaaaacctgtaggatgtcaaactatttgtcaaactgtactgtcactcatgaatatgactgggcacagcctggtgcttcgaggtgctgccactccaatagaaaagacagatgtagagacagatgtctacaaatgaagagtctatagagatgctaactggattctaagagtggggaacatggcatgattcactgtgcttggggagtcagccaggactccctgaagctatgaagaacaggtgcaaatttaccagtggtttaaaaaaaaaaaaaaaaaaagaacagaatcccagacataggaaacaagtagtgcacaggcacagtgttatcagagatgctaggacatttcaatttagtttagaactattggcttgcctggatgtggtggctcacacttttaatcccagcactttgggaggccaaggcgggcaaatcacaaggtcaggagttcaagaccagcctggccgacatggtgaaaccctgtctctactaaaaatacaaaaaattagctggacgttgtggtgggcacctgtaatcccagctactcaggtggctgaggcagaagaatctcttgaacacaggaggcagaggttgcagtgagctgagatcgtgccaccgtactccagcctgggtgacagtacgagactctgtctcaaaaaaaaaaaaaaaaaaaaagaataaaagaactattggcttttgggttttgttcttgttaggctcactcaacaaatataaagggagaaaatgaatctctctttggggaacgctcatcacagagaccaagcatctgatgtggggatgggatgggaagcaaaaggagatgatgttggagaatccgctcctgaagtcaaaggatattccatgctgtcctcactgtgtgaaatgcctacgcctgatggcagggaaaggtggtgctttaacccatgactgtccttagaaaagcaaccacaggtttacagtaacattacgtattgcttctgaggctggagttcagggtgcagagatcttcagtgagtccaggaaggcatgaatctttcgcatggcagactgaggcccatcagatactctgactgcagtagtggttactgctaagcagcttcctgttatgtggctgggagtcactggattcccatggggagggcttctatctccaatctaaggtggcttcagtgcacttcctgtctagttcacttctcccatcccaggtgtgatgggcactaacctctctaccaccaggaatcgcacatcataatccctgagtggtatcaagcaaccctgggcagcttgctgatttggcttcagggtcctttcaaggacagttaaacgccagacacctgaatgaggtcaggggctgctgtgaggcttggagagcatgtatgcaatcataatccctgatgtgatcaagatacagtttgcttccctgcctgcagggtgggtacaaaatcccaacttaggtgaggcaccaccctctgagatggtcttatacataattgcattgtttgctagcaacagaaatccattcaaactcactcaataaatgggcatgtttcttacacagcacaggagcacagaagtgagtttcagcactaaaagtcaggaggtgttctaggtcccaggaagaaccagcatttctgaaccgctgtgtaatcaggaaacaaggcagcccttaccctcccgccccaaaaccctcctccatggctcttccactctcttcttcttctctctctcattgctacttctgctgttttctgcacacgtggcagagaagagtgaccccacagttactgacgacacttaagtgtgccttgcaaattcctaggagaaaattgaacctagatagggtgaggtttcgtctgttctgaacatagcacttactaatggagccaggatcaggcgctgcagacccaatttctggcactatgctagacagagatggggaagggaaatgacttttggggaggctgagtgtgtctaaaattagccataggatgactaagccgatagttccttctttccttccttccttccttccttccttccttccttccttccttccttccttccttccttcctccattccttccttccttccttacttctttccttccccctccctccgtccctccctgtttccctaccttccatcttttcttccttgggtaaatatttactgaatgtctgccatatccatagcattgtgatcagagttaaaatagtgagcaaaacccacacagctcctgccctcatggagctaactaacatgctggtgagacaggcaaactttcatcaaataatttttctaataatttttaattggatgcaaaatgcaaactgggatatgggctatgaagaaagggtgatgggctcttaaagccatgtggtcagggggttccaacaggaagcagcaatgcactggagttaattaggtgctaaaagcatccccagtcaaagccatagcatgccaggcatccctgtggcaggtgaggagtaaagtgtggtccagaatgggaaagtccatggtgctggtacccgggactggggggaagtgtgatctccttactaacaaataaataaggctggagctgtgtctaggagcaaatcattagggatgtcaggagtaaggtaggtttggaatgaaatgggaagccagcaatgtaggatttaaacaatcaagtaacacagtcacatttacattttgtaagggtcacactccttgacctgcatgggggcaaggggtgcaagcctggaggcaggaggagatggcattgcattcattgcctggggaagtctatgaagcagttcatggcagaatctatggaaacagaaacgttgcagtagccagccctgtttagagagtcagagttagaaaaaaactacattctggctgtccaagggtcatcaacaccagtgttttggaagtaatcggtttgctattttgtgcatccatttggatggagtgcataggtgaaggtagctaatgcatgaactgagcattcaccttcattctgcctgactttgttccaatgtcctccgagtttccttcacttgcagctctttagcttctgtgtaatcttggtacaatgaaaattgtgcccaattccactgggacctgagattctccctggtcacaaattgctcttcacgtagtttgcaagagtaattgcaaactcagaacattttagttaaaaaaaaaataacactaaatcactcttctggaactctagagagcatattagggttttcttgctgtctggtaccattgttaatgatcatttctgttctcgctttataacaatggttctcagcctctgtttttataaaataatccccctaaatgactttacaggttcttattagtggaaaggaggggctataaaattcatttcaactgtaggttggattaagaccagatgtaaaggtgtgggtttggactcagatggacatgaaattcaatgttattacctgggtaccaagtacggtagcaccaaagaaggcccagttgctcagagaaacctctttctggaatgaaggtcaatgtcctttcttggtgctgtaaccctctggggcaaggaagaatcacttgttaggctacccaatgtagtgagcagtacataaggggccgtttcccagactacatagttacagtgttgaattaaacattgcccttgccttccagaaattcacagcctgggtaggccaagtccacaaaaagttagaaaggatgtatattctgcttctgatagaagaatatgccaatggccatagggacctcccctaaaattcaggcccactggaagggtcaatgaaagttacagagagcacgcttgggtagatgttcaagtctcaagactccagaccttccatgagttcaaatggggccaggtgaagggcagtttaggatgagagaaggttgtaatcgaagggctaaaggaatactagtgcactgtgtcttaagtatttgatttagctggatcttagaatgtaaggatatgttcggagatggaggaagtgacaggaaagagggggtaggagctgaaaaggttgaacctgaccatggtagctattatttttaataaatgagaggatgcatgcaaattttgatatgaagtttgggctgtactagggattcagtgaaactacaactactataattattaggactcagataatcctgcattggaggcatactgtgaatctctagaagagaaccatgtattttgactatttctattctaattattctaactattcttcccaaatcatgttcttccacttctcacctttacgatgtcagctccgttgccacttccttgatggagccttccccactgtccccggtgaagatctgtctatcttccccactggactgtaggcaccaaggggacagttcctgacatttagaaggcttaataaacaataaacttttaaaaagcaccgactttgtgctaagcacaatgctacttgttttacaaatattaacttttaatattcacctgaattccttgaggcaggtactgtttattcccattttaatgatgaagaaactcagacaaagaaaggttgagtgacttggccatggtcacaaagttagaaggtagtgaagccaaggatgactggaaagatggatggatgggtaggtgggtggatggatgggtagttaaatgggggacagatggatagatagatgggtggatgggtggacggatggatgaatgggtgggtggatggatggatggatggatgggtggatggatcgatgggtctatgggtggataggtgagggatgggtgggtagatggatggatgggtgaatcggtggatgggtggatgggtgggtggatgggtaggtagataggtggatggatggatgggtggatgggtgggtgagtacatggatggatggatggatggatggatggatggatggatggatggatagatggatggatggatagatggatggatgaatgagtgcatcattgctgtttgttgacactagcccatgagattggtcatttttattagttgaaagaaattgaaaacatcaaaatgcaaagcaaaaggctattgaagggtgaatactatcaccaccatttcaaccactgaatagctctatctattcttgggtctctctgcaggtcacccctctttccaatattttgaagtcacttgatgtttttaggtgttgtaatttatcaacaagaggggactcaccagatgtgaagactacacacacatatatatatccacatacatacacatatgtcatcttcatttatatgtatatctgtatatctatatatctagatatacctatcacattaggaaagggggtatattgtctaaacatatctgcaaataatgtttaaaatttacctctaaatcttgtgaactttgttgagtcttggcgtaaattgtactgctgctttataagagtaattcaattatcgatggatcaggattccagaaccctgcaaagtagtcccgtctctgctacttaagtttctccccagagaggaaacaagtcagtatcccaacccccttgggtataggatgccgtaaacatctttcagatctaccagaactcttgatttttctggtaggagatgacctctctttcaactcactgaactataggagattataatagccatttgcagtttaggtgatatttggtttatttaaatatcaatgaacatgaatctcactccctgtgattgggtgatgatagccatatttatgaaatttattactgctaggataccttgtatcataattctactcattgcaaaattaaatcatttccatatttgaactttaagtaagtatcacctgaatgcacattgtagaatcctgcagttctagcgttgaaaggaaatttagaatttatttcatccaagctaattcctagggggaaaatccataatgatatatctgaaatgtcaacctccagtcttaccttgaacacctcctgtgacaagaactcatggtgtaagagaagaatacagaagagtacttccaagcttggtgttgacttgcccgagttcaaattcaggcttcacgatgtacatgcatgtcttgtcaactgtgggagctgtctgggcctcagtttcctcttctgaaatagagaagataataacaccttctttgccaggatctgagaggatgtaataaaaatacatcgaagaactgaatcattttcatcatcatcatcaccatcattgctgttaaattcacaatatagtcagaacctattttgaaggttggtccatattactatgacaaaaaaagtgcggacaaaattcaagaatacatttcttgatactaaagtcattcccctttttcttctttaggaaactggtcaaagaactcatgcaagtggaacttacagcttccttgatcggactcagcattcagtaagtgcaacccattttgaacattcattccataaatacatccatgtctttgatcctgttctctctgaaaagctcttttctgcaggtttgaagttgttacaaaaactttgctgcctgcctatgtctttctcttctgccctattgtatcagagatgagaagagggcctgcaaggtagaaccaccctcctttagccctccctccccaatgaacctgggaaatttgtgaggttatcaatgagttaactgcgcctttattagctggggattaaaataaaatgtgtttttggtttctttttttctccccctaaggttttcttatcaggagacattctgtcccccttctgagtcacatgaccctgcaaagtagaaagaaatgccagcaaacacagatcagttaccgagagcatgtatttcttgaggcatttaagaacagttcatttgctctttttgagctggaatacatgactatgatctgaaaattactgcaaaaaaaaaagaaattttttactttaagatgctggggtacattatagaaatttcatttgttttcagcaagtaagcatttttccactttctgcctttctcattgcatgcaaggactttatttttggtgaaggtagcagtattttgtccaattttctcagctctctttttttatatgcagatatactctagcatttggggtagcaccttcacaaagtctctgatgtcagccctcctctgcaatagttttatgggtgaacagcttgttttaagaagaaatctgtaataatttaattataaatatcaaaattttaaaaggctagctgaaagaaatatttatttttcaagatgtagcttccttcataggaatgcagaatttcttagcaggttctacttctgaaagtgctggagtataatttgatacatcaaatatcagcccatgtcataaaggagcaggtagaattggaggacatgggactccaggcctgcaagaggctgatcaaagggaattcttttgccctcagtgggattgcaggactctttctattgtcttggaatttgcatattcaaatgcagaggggaaggaggcagagatagaaagaactaaaaagatggtgtattagctgttagctacatcagaatgacttagcgtaaccctgatcagctaacgcttgtatctcacaggagattagactggcagcttttgttcctaataataaaggaaattccatgtctaattccctacgtgccacatctatcttttcatgcctttgaagttcaggcttcggcatttcttgaaaactgggaggttttgtaagtaaaaaggtgggggctgtttggcatgaagtctgttcaaatctatttagtgtaaagttaaatttgcttgttacttgatctttttctgtttaaagcagcatctttctcatagatgcctttgttggtgcttgggcagggaggggagggatggaggacataaggtttcaaggatgggttttcagatcatacatgaccttctcattcctctgtcttctgaatatgattgaaattgctgcttctctgaaagaaattcctgttccaaccctgcactgggattgaaacttttaacctaagggaggctgtggtccctaagataattagtacatggatgtaagggagctcatgttaatttgtctatggatatggtatttctgtatctacaactgccatctaaagagagacattaaaaaaagtattaatttactgctctaaaccagtgagcagatataattttttttaaagaaatcattttagaaaggaagcaatggcaagatgccttattggggatgtttatgggtattgatccctcttagtgtatctagtaggtttccatcctgtccttgggattgcagcttctctgatacagcaaacctcaatccccttcagagaccaagcagtcacttcctctggaacaaacattgaattctgggacgtcgcctggttatcaggaaggcagatgatttgacatctaagctggccacatgcctgggttttgtgtgttcttcacccataacatgttggatgcatgctggttgagaaattgctccagtctcttacaggattttagcaggagcgatgacctagtagttggaatttgtacatggctgacactgggcctgggctgatgttgtgaagaatgccatattttagtctgaatccaggttttgatatgtccattggcttcagaaaattaattttcatttcctgcttccaaaatttggttattcttgtttaattttttccagaatgtttcctttgcatcggtaccctttggattgctgtttgttcaatagtatattacccctcatgatatccacagcatttactgtcgtgttggtagaccatgagtacttgttggatataatgatggtcgaacaggtacaacaatggaaagctgaataggtagatgaatgcttcttaactcctgatggagtattgtgtaaattggagaaagatggcattgacattagacaagagaccagtatgggtgtttctgatggttggtttctattccccaatactcttcttcaaagctttcacttctactttgacaggtctagagtaacagattggccaatgcacatggtgtaagagaatgagctcccaggaaccagcatctgttttctagctctccacatccctttgttgttatctgtgtgctaagaggaaagccacagaaagctcacagtagcagggtcggtgttggaacttaagcctcagcatgattttctacaacttgaaaatttaacttccaagaggtttccttgatctctattttcctatcaggctaaaaatcccatggcatgctgcatcatgtttataattaattaattgtgcaaactttatttttatgtttgtctttttctttggtctagtgctatccaatacaccatgtctgtgattataggaatatttttttttcaccaagtcttaatgaggtattattgaccaataagaattgcgtcaatttcaaaagcatactcttaatataattggctttggtgactgagagggggaaggttgggaggaggttgagggtacagataagaagaaggtggagacagaaagaactaaaaagatggtgtattagctgttagttatatcggaatgacttagcgtaaccctaatcagctgatgcttgtatcacacaggagattagactcgcagcttttgtccctaataataaaggaaattccatctctaattccctacatgccacatctatcttttcctgtccttgaagctcaggcttcagcatttcctgaaaagtgggaggttttgtaagtattgggtagagagggcactgcttgggtgatgggttgtttgggtgatgagtgtgccaaaacctcaaaaatcgccactaaagaactcatccatgtaaccaaaaaccacctgtacccctaaaagtattgaaataaaaataaaatttaatttttttttaaattgcgaagatttaaggtatatatgagacatgttaatgtacatataccttgtgaaatgattaccacaatcaagctacttaacatacttatcaccttacatagttaaccctgctaagagaatagataaggaatattctttatctgtgctgttcaatatggttaccagcagccagacggagcaagtgaacgcttgaaatgtgactattacacctgaaaactaactgaaaactaagtgttctttcaaaaactgttattaaaaaaaaatttgttactttattattattattatttatgagacagaatctcactctgttgcccaggctggagtgcagtggcacgatctcagctcactacagccttcacctcctgggttcaagcgattatcctgcctcagcctcccaagtagctgagattacaggcacccaccaccatgcccagctaatttttgtatttttagtagaaatggggttttgccatgttggccaggctagtctcgaactcctgacctcaggtgatcctcctacgtcggcctcccaaagcgttgggattacaggcatgagccatcacgttaaagtaacataaatgtgttactttagttttaattgacaaacaataattgcacatattcatggggtacatagtgatgtttctatacatatactgtatagtaatcaggtcagggtagttaacatatctatcatctcatttctttgtgtccggagagttcattaatttaaatttaagaacatgtggcttgtaacctgatactgtattgttgtatgggatggctttagactagcagccttataaatacaggggctaggtcagaagtgtccgtccttgtacctaggctgatacttagctgttatagatcaattaggactctgactgataaattgctactgtctcaagccccaaagtgtcctctattccctgctgttccatatgttctgcttccttgaatttacccttgatccagaactaaaggtttaatggtcccctgggactctgcacaatgccacagcattcatctattctaactggttggtgcctaatgcatgctgattattcaaatagtatatcacctctgattatttccatggcatctactgtagtgctggcccatagttcaccatcagtacttgttggatataataatggtcgggcagatagagggatggaagaatgaagagatagataaatgcatccaccttttgatggggtattgtgtaagtgagagaaatataacatcaacattagatgaaatactggtatgggtctttctgatggctggtttttatttcctcagtattcgtcttcaaagctttcacttctacgttggtaggtttagaataatagactccagatctatcactgaattctaatgccatatgcagcacagattgctatacatcttcactcatttctttctgtcacttaaggctcccaatgcataacacttgaaatcagtccacgtctcactcattgacccatgggcaccactctcttctcaggaacctcagtcccaagccttagttactaacattgtctttgtttttcatccgccaccaaatgataagtgagtgttttatctgtatcttctaagagacttcttttcattccctctgttggcatattgctccagggacttcttacttacgtatctgggaattctttctaggtagtcttcatacctaaagccaccttcccttggatcccagccaacagattgcaggactaatattcttgaaacaagaatatcgtctagttggttgttgaataagctcatccttacctaacattttatcttttctccatgaatccctcaatacatttcattccaactgggcaagttcatctcttgatatctaaacatgtttatttcccagctccaagcacttgctacacttggtctcaccagttgggatagcctttcctattcttttagtctacacttctatgtagatctctgttaagccctcctgataatgaatttttctctgtttatttcagctacttgattgccccttgtaggataaagaaaatcctaagccaattttcaacgtaggaagttgaccctatgattatattttagaacctgggtttcagtggaacaggcaggagtggaacagagtaaggaggtattgaaagagaaacaacaataattgccttccagggagacacagttctctcacatgcaaaattcagcagatgggttggaagtggaagaggttaaaaggcgccagttggaatacaagagggagagagaatgagaacaggcatggcctagggcattaccttaattcaaggccaggcacagggtgggtttcatgccagctgcatttagagtctgtggtctggaaggacaaactcatctagataatgctcattgaccatcccatttgctttgacacttccctggccaccaaccacccccacacactgttgtttacatttcccctatgaatatctcttacctctcctaagctgctgcatagcagagctcttttcccagcttccctctgcatataaggggcaggaactctgcagacctttttcgatcgaatgagtacatgagcatgggaggaaagagagagagaaagagaaggcagagagagaaaagacagagagctaaaagaagaaataacaattccttctgcttctttattgttaggacagagcaggataataaagaatggaagttacaaggaaggtgtgtaaagtagtagcatgggtaaggaagagggaagcccaggcagcaccccactgtcagcctcgttcttcttcatcatcttacccagttaaaatctgccatggtgcttatgatgctccctgatgaccagttttactgggtgtgcacaatctgtcttccccactggactggaggagttctgagggcatggggtgtgtcagtcttgcttgcttctgtatccttagcacctgtaaaagtgacaagcaggtacatattttgaatgagttgttcattgagttgaatgaatttgtgctgtgaatgttgatcacactctttgtactttcaaattattcttctgtcatccatgactgccggtggcaacccccatacccccaatctagatcagtctttgaaagattaagggagcaatgcttgtgaattgaccacacagctgtcttttgaaaacattatttatatgtttattaatttttcaatttgcataaatttagaggttgcaagtacagtttccatacatcatgggtatgttgcatagtagtgaagtctgtgcttttttttttttgagatagagtctcactctttcacccaggtgggagtacagtggtgtgatatctgctcactgcaacctacatctccaagattcaagctattcttgtgcctcagcctctcaagtagctggtattataggtgtgtgccatcatgctcagctagtgtttgtatttttagtagagaaagggttttgccatgttggccagcctggtctcaaactcctgacctcaagtggtctgcccgcctcagcctcccaaagtgctgagattatagggatgagccaccatactcagccaactctgagcttttagcgtaaccatcaccttaatagtattcattaagtaatttctcatccctcaccttcctcccgccctcccacccttctgagtctccatagttcatgctctgtgttcacaggtacacttcatttagctcccatttacaagaactacataactcttaacaacacatttgaccaatctggcttcagtttcctgattacaatactgataatgaggaattgaactagaatggagtgtcaatttgttctcacattgctataaagagatacctgagactaggtaatttataaagaaaagatatttaattggctcacagagccacaggctgtacaggaagtatgatgctggcatctgctcagtttttggggaggcctcaggaaacttacagttatggcagaaggcagaaggcaaagggggagcaggcacatcttacatggccagagcaggaacaagagagggagaggaggcaccatgcactttaaacaaccagatgttgttacaactcattcattgctgcaaggacagtgccaatgggatgttactaaactgttcatgagaaactgcccccatgatttaatcacctaccacctggctcacttctgacgttgaggattaccgttcaacatgagatttgggtgaggacacatgctctatatcaaatggtctttaactagggccccatctaacttcgaatttagaaagcaaatgagatatagaaactaggccacagaagagaaggttgaagggaagtatcattatctcagcaagacagagatggataagttacgaccagaagcagtcagtccctccctggcccacctgtgtacagaaattagcccattttctcttgacaggagagtgtactatgtagctaaattaggtttgcaactaaatcagtacagacattttgctttctctttgctataatgagaaactaatattaatataatttgatctacattcatgggttgtagtaacgaattacaggaaaggtacccaggcatggtggctcatgcttataagcccagaactttgggaggctgaggtgggaggatcacttgagactaggagtttaagaccagcctgggcaacatagtgataacccatctctacataaaatgtttaaaaaattatccaggcatggtggtgtgcacctatggtcctagctacttcagaagctgaggcaggaggatcacatgagcccaggaatccaaggctgcagtgagttgattgtggcactgcacaccaacctggaggcagcaaagccctgtctgaaaaaggaaaaataaactaagaattatggataatgaaagcaaatttcacctgcattcaccttctattagctttaacacctatgaggtgaaatctttgtatttatcattatcgttcaccggttaccaactgaagaaaaacagtaatgatatttctgctgaatcccttcatttaaactaaagagtagctctgcttgctgtctcagctcaacctgaggatgtagtgttgttttctgaagacattagtgaatctggaatcacctgattcctactggtggttcctgtagaagactatggaagtcacaaaggatgaaccaaaattttggtaaaataggctggttaatacgatatggaaacaggaatttggtttttccaaattcaggaggctagaatttcttcctacttttgagaagctccaaagcaaaaaaacacaaactttgtccatgtatagatggccagaatggttttattttcctaaaatatatgcctagtttcttttgaattcaggtggttatttgcagatccttgcttcagaaaataccagcccaactccatgcctggcttacagttggtacacagtaaacagtaacaatgattgctgttattgctatttaaaataattatgtgctgagaagggatgtcctctcccactgactgacttgtgtgcgtgagtgtgtgtgtgtgtacatgcatatgcattggcagaaaatcggttaactcttattgaacctcagtccctctgtttaaggagaataaattgtcttgcaaaactgcatggtggtacattctagctcaagttgctatgacattgatatggaagtcaacatgcttatcttggtaatgccatcattccttccttccttcattcattgattcattcataaatagctatggaaaaattttgattttggattctcgctaggtactgaggatatcatagtaaacaaacagatatggtgctgtacactcatgataacattggaagataaaactttaaagtaaataaaataatccatgtgagattaactatcacagactagccaataccagggagggctcaggaatgtaaggatgtgattagtttgaccagatgtgagagaggaccaaggagtatcctagatacaagtactttcttctctttctttgtcccagcccaggttttctcctttctaatctagctggctttcttcatccttctcagagggcattctcctctcagggttgtttcgtctcccagcaatgaccatttacgcttcacagggacagactctcccaccaagtccataaacctgcactctgtgcagaatcattgcccatttacagctgctaatgcattaataacagaaacgtccgtggccatgacctacctgagtcattacacactaatcataggaggcaatttcaagcagattgactagtgatcggtgtcctccctgacgtccaggcaggaggacacacgactgccttcacaaccccagagcagatggcccgagagcataatcacacactacagccggtgcaggtgtggctccaggaagggaaatctccatgtcttgcatgcaaagctgggctctctcacctggaggctgtgctccaaatgctcgtctttcattttggagcagaatccacatctcagggaccttctttgtgctcgttttaaacttatcacacagacagctctctgaagacatggaggaaatgagattcacctgcacctgaatggctctaacatgcaccactgtccacaagccactgtcgttccttctccactttcctctgcaatcccagtccagatgtatggtccaaagctgtggtcatcatgggcttgtgatttgtgttattatttcttccctgaagctgcttaagcattgttttttattcatgttgctctctcattccctgcgatcatcattataatggccacacaatataacatcaggatgatgtttttccgctttatcttagaatatctagtaggtttctgcttttctcactaataccagaatcactagagttaattacttagcacctatagagttttcatctttgggataagtgcctgagaagtataagtcaaaggatagaagcatctttatgactttggatatatttttctaacccattttttaatggatttgctcatttacagtcagttcgttgtattttgggctttctgctcttagctgcctattgtttatttgcccataatgaggactcagattatatttaagaggaactaggcaatgactttgcaattaggagtcaaatagaatctataccttcaagaaacagaatagagagggaatcttggttagaaaataactcattgctctatgacatgataatgtccaagaaaagaaaaaggagtttcagaatacatagattctggtgcaagacatgatttctatacagattcaagccaggagcctctcttcttgaccgatctgagatgaatgccatgttatttcttgacaaaggttaggaaatgaggggtctaatggctcttcaatcccgtgggttactgttctatccataaattcatgtataagaactttgttgcatgcaccgtggtcccagtctgcttttatggggcgtacactcagaagacagcttctgaaaatgatctgggtggaaacgtataaaggttgtgcattgccaatttgcagttgcaaaaatctggaaccagccctaatgcccatcaatcaatgagtggacaaacaaactgtgacacaaacacacataatggaatactactcagccataaaaagaaatgaattagtggctttttcagcaacctggacgggattggagactattatcctaaggaagggaaaacaaaatatcgtatgttctgactcataagtgggagctaagctatgagaatgcaaaggcataagaatgatgcaaggaactttgggcactggaggggaaagggtgggagggggatgaaggataaaagactacaaactgggttcagtgtatactcctcgggtgatgggtgcaccaaaatctcacagatcgccactaaagaacttattcatataacaaaatgccacctgttccccccaaaaaccgatggtaataattttttttaatgttgtgcattgtgaggccaaataagctaggattatttttgggtgtatatgctcaatagaccctatgggtcacatctagcagttcattaagattcaaataaacaaagcagcagtcccagtagaaaatgcacagccttggagacaaccaaatgaggattcaaatcttggccctctattcactatgtatgcaaagtaggaaagttacttaatccttctcagctccagtttcatcttctctcatgaggatggcaataggaaaccataggtctcttgtgaagattaaataaaaattcctttttgggaggaggggatgcctgttagggataaaccttttactatagagaatgggacccaaggagtatagcttgggcagtgatcatttcagcaaaagggagtcgtgattactgctctgctgagttaaagaaaaccttgtgctctgataaggaagaagagagaagagagaaaatgaaagacaaggatccaaccaacaagtgggtgggaatcagatgtctatgtgaaagaaagagtccctaggaaatcagcagctggttctgaagttcaatttgaagtggtttgctgtgtggtaaaccaatccccccgactctgtgtgcccttttctacccttccccctgaagttaatctttcctttcaaaactcatactcataatggtttgagagtgatcatggatggaagttatttcaagtgctgaattcctacctgactccatgaagtggaaagcagttgttgttcctagtcattcttaagataacagctaacatggtggaagttttgcttatgggccaggctgtgtactaagaagtttacaagcatcacctcatttcatccttataatgactgagtgagataggttctgctaattattactcttctacagatgagaaaactggaactggaagaggatacatagatttcttaaagttagacagcatgcaaaagctggagctgagtttgaattccacccatctcaactgtggagtctacgctcttgaccactatactaaactctttctatatgcagaactctgagacaaaagttccagtgggactgtaagtctcatcaaagaaatagtgacaaaggcgattgtcttcatcaggaggtggccttgaggattctggtgcctggagacctcagctaatgtctgggttatatttacaactccacttcttcaaaagatggatgaaggccaggcatggtggcccatgcctgtaatcccagcactttgggaggccaaaacgggtggatcatttgaggtcaggagttcaaaaccagccaagccaacatggtcaaaccatgtcgcttctaaaaatacaaaaagaaaaattaagtgggaatagtgtcacacacctgtaattccagctacttgggaggctgaggtaggagaatcacttgaacccaggagacagaggttgcagtgagcccagatcacatgactgcactccagcctgggtgacagaagtgagactctgtctcaaacaaataacaacaacaaaaacaaaatcaaaaaccacaaggtggatgaagttgatgactggtatgattttaaaaatattgacttctactgtgtagctttccttcatctttcccttcttccccatgcaaagaaagatgaagaacatgagcacactgtacaataatgtatgtctgtagtttaatactacatatctgtagtttaatacttagtatgcaaatattctaataaaaaagtcataaggatagggaagtaaaggaaggagaactattctaaagttcaaaaataccttattattcaaagcacatggtcttactcctgcgtagtggtggctgaaacagattgcaagctcctttcctaaggctgactctgcaaacatgaggttttgaagaacttgaaggtttcacacctgcacaaaggctcccaagaagccttgcacagcagctctcgtagtactgagctcaaagtcactgatgattctgttcaaaccctctagtccccactatgaaggctttgaaaagggatatggtgaaaggtgaggaatcagaatagggcccctaacattcctgtgatgctcttcctcatctcttccttactggaattgctgtctcactatatcaagcagggaactacagcaattcattcattcaacaagtacatagtgagtgctcttctatgctaggcatgtgctagccgcgagagacacagtgggaaaaccagacacccatgctgcctagactcaggggtcttactttctctagaggaaacaaatattagataagtaactgtacaataaaatagtataattacaaatcacagtgagtgctgcaatgtaaacacaccagcgtgtgataagaatgtatgcagtgtgtggccatttaatgtaggtgatcaaggaagtgatatttaagtggagacattctagggcaaattctctgggagaggagcaagacttcggtggttttggggaattaaaggatggtatggttagaacagaatcctagaaggggacataggatggaattgaaagagcagatatgagagagattaccatcaaggtacagacttcagattttatcctaagtgccttgggcagctcttaagggatctgaaaaagtaaggaagttagtaatacttgtgtttttaagaaagtattgatctggctactgtgttgaagaaggcttgaagaggaggcaaaaagaacagttaagtgggttattgaaatagtctggggccgggcccagtggttcacacgtgtaatcccagcacttcgggaggccaaggcaggtggacgtggtcaggagtttgagaccagcctgatcaacatggtgaaatcctatctctaataaaagtacaaaaaattagctaggcatgctggtgcatgcctgtagtcccagctactggggaggctgaggcaggagaatcatttgagcccgggaggtggaggttgcagtgagccaagttcgcaccactgcacttcatcctgggtgacagaatgaagaaaaaaagtctgggagggaaggatgacattggcttagaataggggtgagttgtgggaatggatataaatggaaggatcctccattttctgtttctctctctctctctctatatatatatatgtatataatatgtgtgtgtgtatatatatatgtgtgtgtatatatatgtgtatatatatatatataatctatctgttaatctatcttctgttttctattcagtgttgcataaatctcaaccatttgctcaattctctggtgcatcagagagtgccaccagtatgtcctaagtcctgcagaaatcatgcaattttttttgtttcacctttttttaaaaaaaaaaattgtatttatttgtgtattgccctggaaatgtacaaatagtttcttcttcccctattaaagtttgcttggtggggtcttgctggttcctgagtttgccttggctgccatcttccatcctacctaggatgacaccatttgtttcacataagtttctcatgcatgagaggctgacattcttaatagttctgtcactcctgttacaacaggctgctgaaaagaaacaagcgatgcctgcaggagatagggctgtctcagcggtttgtgtaacaccaatggggtgtgaggtagcaggaaaataattagtttagttagatgtaaatggaagacgaatgaagaaagtgctaatatgtggatgcctgggagaaggggtggcctgcctcatttaaggtttgaggaagaataattgaatgaatagctatgaaaatgaaagcaatattaagagacttgtatggcaacgtagaaggcgggaagagctaaattcgatcaaccagcatttactgagtgtttattatgtacctgtcactgtgtgaggcattttagctacactggtgggaaaaaataatggtaagacataaataagactttagaatctccgtggaagtcaaaatttcagaacatatgaatgcacaaacagatattagaaaggttggatagcaattgtaagctacattaataggcaaaactattagggatggcaggaataatgttgaatataggagacatgactgactgtgacgatagctagttgatttaaattctcagcacattacttctttccttcataaaatgttcatgtcacagcatagcgtgctgttatatcttcatacacacacatgcacacacatacacatacacatctggtcaaggcttgtgaggccacattaggggttctgggaacaggaaggtagtggagaaaaattccctctcctaaccatttagtgtataggagtctactgttttagtgaatagttcagagaacttaaaggtgttcagagaagagaaagtcagcataaaccatgccgtggactagaagggtagatgaaaggtgttggaaaaatgtagagatgaatccttcattgatgatgcccatctcttatgaaagttatagaacatagatgatcaatatattagctacaccttacagaacatgggccattctaacagatcataatcattatttaatatcttactgagagttttgattgtattttattattgatccaatgtcatgttttgatgtccttgacatgtgacattctttttttttcttttttgagacagcatcttgctctgccacctaggctggagtgcggtggcatgatgtcccctcaatgcagcctctgtctcccgggctcaagcaattctcctgactcagcctcccgagtagctgggactacagtcatgtgccaccatgtccagctgatttttgttttgtatttttcatagtgacagggttttgccatgttggccaggctggtcttgaattcctgagctcaggtgatccacatgcctcagcaccccaaagcgctgggatgacaggtgtgagccactgcgcccagccagacattctttcctttgctatactctttcatattgtttaaagctgttttgttctttggatctgatagttctgttgttttagtcctgagatttctccatttcttttctgctttttattcagtgttttttcaaatctccctttgtcatcatagcttctctttgcctcacattcttttctatcacttgtcaaatttctcatcagcttttcatccttgatttttcagagtttggtttacgaaatggtccagtcatttctacacctctgaaaaactcttaaaattaaaaaatatatatatcagaaatggatacaggcttattttcgtggatggacttaagtttagaataggtggcatatgtttaagtttttagatcacagacattaggaattggcttttaaaagatgttacatcaacgaatggttagaaagcagtaacatcttttctacaaagatacttgtcatctgtcagatttatttatcagttaataataaagtgatttttcatatcactagatgattttctactgtctcattagttgaagaaatcaaaagaaagccaccctatgctaactcatagaagggcataactatttagtaccccgagggccaaagaacaattaaagtgaattaaaattatttcttttttggtgggggtaggggggagcaggaaacagaatgactagactccgaaggatttttctagagaaatattttaaccattgagtaaattttccttgattaaagaaggaaataacaacttggagaggaaatctaagtattactttagggttattgagagatgccggctagtggtacttggaaagataaggacaacttgtcagccactccacagagaagtagttttattaaaagtcaacgaaagtggccaggtgtggtggctcacgcctgtaatcctagcgctttgggaggccaaggtgggcagatttcctgagctccggagtttgagactagcctgggcaacatggtgaaaccccatctctactaaaatacaaagaattagccaggcatgttggtgtgcgcctgtagtcccagctactcaggaagctgaagcaggagaattgcttgaacccaggaggtctaggttgcagtgagccgagatcatgccactgcactccagcctggacaacagagcaagatagcatctcaaaaaaaaaaaaaaaaatcaaagaaatatgctagaatcgtcattatatattgagaaataagattcaatatcccatagatttaggcactcttcacatctgtgtatctggattgggtcatagggagttttattccaggctgagtgaaataagacagaggacaggcaagtagatttcttcttgcttgccagttctcattcgcagaggatccctgtagttctgttgagaattcattggaactcagccggaaagtgctgagattgattagcaatgtcttccatgggtacaggaaggggaggtggcaggtaacatatataccagcttttgccattctgctctagacagaagaaacttttcccctgtggtcaaagagggagagatatttgcttctggagactggatctacttgggttggtgaatgcattttaagatgacctggtttcatattactgtcaagcaagagagaacagtgtcatcctataatgtcaggagtaatgttacagttcagttgggaatacctattatgcctgttagtatttctaactaaatcccctttcgatgtgatagtttaattgtaggaacatttttctgcagttttgtttagggaatactgcttgcttagcgcttaatccatttatactattggattctgttgcaaatgacactcacactggaatgtgtgttagacacgtaaggcagacgggaagatggttccattcatttcagagaaatgggaggcaaaagtgagtaggatggctttgaaggtggtggtcttatgtttgaatgcgcgtcaggccccaggtggtaggtcttggtactgcatgctgctttattcatgcatctctctaaacaaatacgtcctcagagaagagagccaggagagggaggaagttctagaaatgtgctattggtaaatatacctaaagacagtggcatttctttaaccatgttcatcataatgagaaatgcagtaaatatgaaaataaaaaatcaggccgggcgcggtggttcacgcctgtaatcccagcactttgggaggccgaggctggtggatcacgaggtcaagagattgagaccctcctggccaacatggtgaaacctcgtctctactaaaaatacaaaaattagctgggtgtgttgacgcgcgcctgtaaccccagctacttgggaggctgaagcaggagaatcggttgaacccgggagccggagattgcagtaagctgagatcgcaccactacagtccagcctgggggatacagcaagactgtctccaaaaaaaaaaaaaagaaaaaaaaaagaaaagaaaagaaaagaaaaaataaaacaaaaaaatggaaaatctgtagtaaagtcagagaacctgcattgtgatatttcctatgtccatatgtccatcattgttctccaggtattgcctggttttccagcctcacagtaggcagtgggtgagagacgcagcatgatgggagaatgaagcccattcatagtggaatcaagcctccatctttgacctcagtctgtgaccttggcagcttcttgactctgtgagccttggtttcctcttttggtaaatggaacaacaaatggatacttgcaaataagaaggcttaaataactgtgatatatatatattcatatatatacatatacatatatatatatatatatatatatatatttttttttttttttttttttttttttttttttttgagatggagtctcgctctgtcgcccaggctggagtgcagtggcgagatctcggctcactgcaagctccgcctcccaggttcacgccattctgcctcagcctcccgtgtagctgggactataggcgcccgccaccacgcctggctaattttttgtatttttagtagagacggggaactgtgatttatttttagtctcagttgaaatggggaccctatggctctgagaagtcaagacccactggtaagtaaatgtcagagctagctttgaacttcagcattcttcctacagagctgatatctcatgatgtgctgtagagagggctggatttataatctagagagggctggatgttgattctaaaactagtgcttcagttccagcctcatcacacaccacccgggagaactttgccagttgtcaacttccttggcctctgtctcctcatctctgaaagccataagattctgtaaagaggtgggggggaaattggatgagatgatagatgtggagacagtttgcacagcaggacaggctatgcagtgggaaagtaccactgtaaggaagactggatgtatagctgcagaaggtcagagaagacatagaaaatcctttaacacctgagtgaaaacgatccatgacaaatgaagttacttcatttaaaaagagcctagtcagagttttatcatattcaagaaatatcatttattggcaatctactatctgcaaaatcactgttcgagtttttctttgtgatccagagcagtttacattgcaacccttattctaaaggaactcaaaatggcattgaggaaagcatttttcaatctgacccattttttggaacccaagagttcagagcactttatattactcgacagtttatttccatggagggagtctataaatgctttatatttatccatgttatgaattaatgcatttctgaagaaatccacccaccatgtggcatgttgattccccttttctctcatttcccccaaaacaccaaagaaggagggccctatgaggttcaatggtctcctttaatggtgcatttaaagtcgacatgctgatgccaagtctttctgtattgtgccgtcccaacagggatggcttcttagcagcgaatatggggtgagtaatttgaatcaccgccatcaacctgaaaagccaaagttgttccaggataacccaaaccagaacaaacctcagatatttgcaggtgaaagaacgagaatacgaatatatgttgtgggctgggagagccaaaatggcaaaggagtggaaataaattaatggggggaaatgattgatgtggaagtaagtctctcaattgtacacctggatgccacattcttacaagcagcccagtagaggcagatatataggctacaaagacacgtgctgtcaagcagcaagcactacttattgtctctgttttctctctaattgatacgtgtcttaggaaagcttaggtaatcacttggcaaaacacatctttataagaccatctctgtaaaaaaaataaaagtattaaagtgacagtggcacagaaaatcataagaaaatttttccacgttgagacgaatcctcctgcctcttcttgagaatccctccaaagatatcctgtatgtctgccttgtgagaaaacacccccttgggtacaaactggtcaatatcaggaaggcagcatgctcatatctcagtcccaatgcatgccaaatcactaagtggatggcattttcacaaagtcagaaaagcgacagttttattctcaaggttttgttactatgtttcatgatgtgcaagcaatactttggacaattttatccagatggttttgtccaggtaatttttgtctgcaatatgtgaaatacgtgatattctactatcagatactttggattactgttttttagtggtgagaataaaaagataccttcattttccattaagtattacattttatgaatattttccccacctcttcacttgaataccttcccactgcaacacacacacctacacctgtattccttttgatccataattataagcttttgaagggattatatcaagattacctatttttaataccatgttaataattagacaacttgccaatgttgaagtttgttaaggtcctctccatcacaattcctgagctaattactagaatatcagtcagtaggttctaaatcaaaaactctgggcgtgtgcctagatggaaatctgaatttttaataggcagatgagttgatctttattaatagtagtttgaaaactaacacagttcaagcaaaaacaaattctcatacagttgagcactgggactaaaatatttttttaaaaacttggtcactggatgaaatctaagttcttggctttctcttaaagagtactttaaaggttagaaatccacaacagtggctacctggttatgtaattccaaattcattcctcttctaagacatacaatggcactcaagagacctgaaaaagttagttcttcttcaaagagtgcatgtttaaccaacttctcaaaccaggtgaccattattatgttcactttcaaaagtacggaacaatttgaacctgtagaaatgtatccaaaggaacttaatcttttattttgtggtaggtacacaataaaagttttcttcattgaatgaattagtcaagaactcattctcataatgcaggagaatgaaatgggaaggggtgaggggtggcatagctctaggagactggcatgattacagatttgggtaattcccaggatccagtagcctggggcagacttagacaattagatagaaggatcaggagtggaatggaatatggcaagaaatgtatgtgcatgcagtgaaagcgggcagaaaacaaaactcattgattcattaaatgaatattttatggaatacttactgtatgccaggcactgtgctgctgaggaaggccaagttgacagagtaactggccatcccaggatttccacaattgaggagtgtccttagaggtgggactttcatactaaagccagggaaatgccaagcaacccaacctgagtcaatcatcttgaacttgaagaagtgctgtgattttaataggtttgttgcctgatgtgtgcagcaagtcaataggagacactgggttacagcagagaaagtggtttaattatggggctgctgaacgaggagcagcaaacatcaaatccatctcccggaggagctgagggctagggttcttggagagggctaaaatgtggagatcattcattgatcaaagaggtcatcgtaaagtcatggacagggaggtaaacagtattctcatactgattctgttcctctctgggaggtctttaaactggttggcatcagctgtttcactggaatgttggatttgataaacatcttaagcgattcctttattttttattttattttattttattttattttattttattttttgagagagtctcgctctgtcacccaggctggagtgcagtggtgtgatcttgactcactgaatcctctgcctcccaggttcaagcgattctcctgcctcagcctcctgagtagctgggattacaggtgcctgccaccatgcccagctgatttttttttatttctatttttagtagagagagggttttaccatcttggccaggctggtcttgaactccagacctcatgatccacccacctcgtcctcctaaagtgctgggattacaggcatgagccaccgtgcccagcccatcttaagcaattcttaaacaaaagctttatgattctagtatcagaaatcctatgtacaggaacaatggggatgcaaaaggttggtatctagtgactttcagttagaaggaagtggaacaaagtgcagcctgattaatacttaattatgaccatatttctgcccaaaattcttgttaaccatgtgaggatggcttcagtgctaacaagagtgatgaatagtatgggtgctaaggggtcacgaaacaggccgtccgactatctgcagcaaggggacaggaagtataggggttgggggagagttaggcctagctcactcatgacctaaattagttactggtgttaccgaaaatgggtttggatccagactctaagacagggttcttggatctcaagcaagaagtaatttagggcaaatccacagagtaaagtgaaagaaagtttcttaggaaagtgaaggaataaaggaatggctacctcataggcagagcagcaacaagggctgctggttgcctgtttttatgattatttcttgatgatatgctaaacaaggggaggattatttatgccttccctttttagaccatgtagggtaacttcctgacgttgccttgtatttgtaaactgtcatggcactggtgggagtgtagcagtgaggacaaccagaggtcattcccattgccatcttggtattggtggatcttggcttctttactgcaacctgttttatgagcaaggtctttatgacctgtatcttgtgctgacctcctgtctcatcctgtggcttagaattccttactatctgggaatgcagcccagtaggtcttagcctccttttacgcagcccctattcaatatggagttgcccttgttcacatgcctttgacacaagagtgagccagggaaagagagacattcaaaggagaggtaacagcacttctggggacctgggggatcacaagcattaggaaaaccagaagaaaaaaggggaaggggtggacagagagtggcacagaatgaagccacagagatgggcagtgtccactgtctctagggtcttgtagggcatgtgtaagctttccactgatgctgcatcaaatgatcacaaatcattgatttaaaaccatgcaaattttctgtcttacagttctggaagttaaaagtctaacatgggtcttactgagctaaaatcaaggtgtcaatggggcagcattccttctgaactctctatgggaaagaacctgtttccttgcttttttttggccactagaggctgcctacattccttggcttgtggcgtccttccattttcaaagccgacaatggcaggttgagtctctttcacatcaaatccctctgatactgactcttcttttacctcgttcttctccatcttgtataggagatgagtaaaaggaggttgagacttcctgggcggcattcataggaagttagggattcctagcctctagatatttacagttaagggaacagattaataatgtttactaaacagacccaggctcagaatgtcctgatatccccatatcttgaaaacaaaaggattcctaattttgctttaaagataataatgctgattcttgcaaaatatagtaattaagaaaattaatcctttatcacaaaccctgatagtaaagcacatcttcccattttttttttgttatgctgtatataaacaagcattgtacatagggtggctggtttcctcctcttacattatgaatgtcctactctgtctatggagtagctgttatttcaccactttactttctaaataaacttgcttttggtttgcattgtgggctctccctgaattctttcttacacaaaatccaagaaccgtttattggagtccaaatcaggactgctttctggtgacacttttaacgattctcgtgattccactgaacccacctggatcattcagaataatttcttgcgtaaggtcaactgattagcaaccttaattccatctacaaccttaattctcctttgcaataaaacataaaatacttacaggttccaggaagtagcatgtggacactgttggggggcctattattctgcctagcacagggcacagtaaggattttgtgcaaattcaaacaggaattggcaaactatcaaagccctgctttgaaggggagtgatggtggtcaatttgcatttcaaaggatcactctgctgcaatgtgggaatggaggcaagcttgtgtaagggattatcagttgggaagctgttgcagagctcctggggagagatggcggtggtctggactaggatggcaccacgaagatggacatgtggaaatgcattctggctatattaaacagggagaattgacatgaattagagatagattaaaaacaagtagaaacgaaggatcccatgttttgccatggcaatcttttcacattgaatgaatacaaaacgtcaaggtgcttagcatagactagcccatgaatggcacataacagaaacaaccttgataaggttcctgtctctaaatttaaagatgtgcacagcaacctcacgagattcaaggttgaggcattgagggtagaagaagtaatgaagttaggtaggttttgctgagtggcatccacgtggatgtctattagagagttaggtatacatatctgaggttcagaatgcacattcctgtccatttcttccaaatataacctttattcctctaaatgctttttgtgaaatgtgtttggtatttgataaatctcttcggtgcgtatctccaaatttggagataggaaccttatcaaggttatttctgttatatgccactcacaagctcgtctatgctaatcaccttgacattttgtattcatttggtgtgagaggaatgctttatcctacattgatggggacacttgtttctaatgagaaatctgatgaaatcaggtgctttgaatacagatcatctccaaacttctgtcgctttatattttttctgaagtttgtctcctccctttaggagaccatggtttttgatacgaaactccatctgatagtcatttctgataaggattttacttttaaatccatcaaaagggaggagaagtgacaatttaaagtgggcagatggaaaaatgagtctcttggtctttctttatttcttatacccctcttcctctctgttcttttcacaaaagatagtctcatcagaaattcggggaaaaatggcttttcattcttattctcattttctgacattcttactctacagtcattattaatgtagaaaactctgtctattaggtaatctgtgtcttcccctaccctggtggtatttcattatcatttaaatatgccacccactgctccttctcaaaccttttgaatagagggtcattagtagatttttccccctaaattatgctcagcagttgttaaaggaagatagtcttcagggaagttctttctacattgaagaactgaagtgaggatttgcgataattatctggataactcagcctcttcttatccctcctgaggtggaacatatttcctgttctctttcattccttccttctttcatttcttatggattatctttgccacaaacaacaacaataataaccaaaacaaaaccaaataaggtattcatgtttccatgcttcctatagatgtagaaagtttttaaaaagtgttttttgaattgctagctactgtttaaaaattaatacaaatgcatgtcaaacttcctatgagacattttaaagcaggactcgtcttgagatttgaatcagtcgtctttctcagtcattttgggggattaattctgtgttttccatgcataatattccctttggattaaggattactatgaacctgggctttgtcttcatccttaagaatcaccatcccctgagaattaaagatgatgcttctcatgtaaattgcttgaggttttcacgagtctctggctgttacaaatgtcagctgagcacagtctaattctaatcttagcagagtaacctctcctgggcatcggagactgtgatgaaaggaggtaatcagtccttcttcatctctatttctcgtacccagtgccacctgatatgcatcatggaaactgttgttggaggatcaatgtctaggagaggcactgcttgatcttatgcaacctccacctcccgggttcaaatgattctcatgcctcagtagctaggattacaggtgcctgctgccacacccggctaatttttatatttttagtagacacggggtttcaccatgttggccaggatggtctctaactctgagcctcaagtgatccacccaccttggcctcccaaaatgctgcaattacaagcatgagccaccatgcccggcctggtattatacaattacacaatctttccttctctcttcttcttttttcttttttttcttttttttttttgagacagagtctctatcgcccaggctggagtgcagtggcacaatctcagcgcactgcatgctctgcctcccgggttcacgccattctcctgcctcagcctcctgagtagctgggactataggtacccaccactgcgcccggctaattttttgtatttttagtagagacggcgtttcagcgtgttagccaggatggtttccatctcctgacctcgtgatttgcctgcctcggcctcccaaagtgctgggattacaggcgtgagccaccgagcccggtttttttttttttttttttttgagactgctctgtcgccaaggctggagtgcagtgatatgatctcggcttactgcaacctccaccacctgggttcaagcgattctcctgcctcagcctcccgagtggctaggattataggcatgtgccaccatgctccactaatttttctatttttagtagacacgaggtttcaccaggttggccaggctggtcttgaatttctggcctcccaaagggaggattacaggtgtgagccaccgagcccggcctggtcttacagaatctttgtgagcatcaagtctgtcatttgtaaaacaagaacaatatatggcggcttttagggtgttatgatgatacagtaggatgagatgtttggaagagcaagacactagattcttgtgaagcaaagcattctcctgtttgccacttccttgttctctcctaggtagacttaaacagctcctgctgcagagtagatgaatccccacattggcgctgcgtccaggagggttcttggctttacccagaagagaattcaagggtgagccaggtgtgttaaacagtaacttttattgaagcaactgcgtactgctccttacagagcagggctccccctataggcagtgtgcccagaggcagttctgcagcaatatttatgcccacttttaattacatggaaattaaggggcagatgatacagacatttctaggaaatgggtggtcatttccaggtgttgccatggcagtggtaaaccgacatggcaggctggtgtgcatgtctaatggaaagctgcttctcccccagccctgttttagcgagtcctctatccgacctggtatgggaatccccacatccagagtcagttgccacctcctacctcacttccatcatcctttatacttactcggtcccagctacatggcagacataatcctaggtgtgaggatgtgttgggagcaaactcgagtttctcccttcatggagcttacattctaaaagagggatcagatgttgacacatgtgaacccatacaatctaagactggtctcagttaatttagaaagtttattttgccaaggttgaggatgtgtgcctgtgacacggcctcaggaggtcctgacgacatgtgcgcaaggtggttggggcacagcttggttttctacattttagggaaacataagacatcaatcaatacatgtaagaaatacgttggtttggtctggaaaggcaggacaactcgaaacaaaggcaggaagactcaaagcggggagggggattccaggtcacagataggtgggatacaaagtggttgtgttgttgagtttctgattagcctttccaaaggaggcaatcaggtatgcatttatctcagtgagcagagggatgactttgaatagaatgggaggcaggttggccctaagcatttcccagcttgacttttccctttagcttagtaatttggggggcccaaggtattttcctttccaacacatatgcaagtgaatacttattatatatagtgccaataatgagcccaaaacaagcaatccatctgagagaatagaagcggccagaaggtactgctgtagatagtgttgttaaatttaactatatttggcctgaggatgcctctgtgactgagtccttagttaacaaactacagcctaatttagtatgtgaactaagtgaaagcctaacttgggaatgtgagtctgtaacaggttgctgagtctcagccaatcacggcagctcagcttcagataatcccaggcggccaagggatcaggtactgttccaacgaggcaaggctgatctgtaactaatcaaggtgcttccctacctcacttctgttttctgtccataaaggctgactgcctgtgttgaggagtggagctctctgaaactcttctggttccgatggcagcctgattctcgaattgttccttgctcaattaaactctgttagatttaatttgtctatagtttttttattttaacagtgtcttgataatgcctcaagaaatgcctttttgaggttatgatgttggagcagagagttgaaataacttcgtaattgaggcttgtcttgggatggttgatgttagtcatgtcaaacgctggatctctcatatattaccagaataacctcttgacaagacagagttttctgtttaactgaattatgggagagcactacctcaacagagtcttggtggtgttccaggaggatgggcaaattcaggatatttattgagatttcaatgtgtgttgtaaggtgggtctttccatgtacagccttgtttacattgaataaagatcatgatattatagtttagaatagatggacagagcaaggcaaggatattgggctgaggagttcaaagaatcttagggtgaaagtggccatttgatgctttctcttcaagagtaagtgggtctctgaagaagttcctggaatgggcaataaagccatttggacttttaactttctggccaagagtttcctggaatagtaaagtgatgtgaagaagagagtcaactagggaagtcatggtaatgtagacagtgaacgggagatggttctcatcctcaaccaccatcatcatcattgtctctcctctttactgggggcttcatgtgtgctgcatactatgcttggttctaaagatacagctgtgaacaaacaggcatgttcctttcttctcatttggcttataatctacccgtgaaggtagatgctaaacaaatggttgcatgagttaattacaaatgcaatagttgctgtgaaaagaatgttcttcactatgacagtgtagtgtcaatcatggggcgctgtggaggcctgggagtaactgagagaggctttgcatcttgcatatgcatagatgctagctgggtgaaggacgcaagagacggttgggtgaaggagactgaagtttatcttagagcaaggagaaacaaaatgtccctgtatatcaacaattattatatcctatgttcacagagaacttgacacaaataatatcataagacacattcacagtacacagtgacagtgcttggaaacatcaaaattgacagtctacctgcgactgcctggcccattcctctaactaaacagcagttgtttgttgaaagaatgagtgaatgttgaattaatcaacaccatttagttcctcagtgacctccaacagctcatttgctcatgcagatcatacagaaactggtgagaagacatgtttgcatctcagcctagcttactcctgaatacaagaaagcaggaaaacaggccttcaggcgtgaaagtgggtggtggaaacccagcccgttcatacctcttggtcaagtttagctatcctaagtgtgggaggcagagaaggggaaagaggcaggagtgctctgagggaggttatagctttatgggtttgtgtggtttgaggtctttgctcttggttttgagcactgtaggagaggagataggcttgtgataaaatgtggggcacatgtggggtcaggccatccaggttcacactccagctccactgtttaggagctgtgtaaactcaggcaaatcatttagttccttcttgtctatttgtctcctctgtaaaagagagatggtatagatgacaccatatgcttcttggagaattgaatgagatacttcagtagaaagcacttatacagagacttatatggcatttctatggcaaatgctgcccttacgtcaggggaaatctctttgccctgttgtagtcctactcatgcttggtgagatggtatatcagcctgttcttgcactgctataaggaaatacctgagacggggtaatttataaagaaatgagcattaattggatcatggttctgcacgctgtacaggaaagatggcagaatctgcatctggggaggcctcagggagcttttactcatgacggaaggcaaagcaggaggaggcatctcagagcaggagcaggactgagggtggggagcgtgccacgttcttttaaacaaccggatgtcccgagaactctctcaggagacagcaccaaggggatggtgctaaccattcatgaaggatccacacccttgatcccatcacctcccatcaggccccacctccaacactggggattacaactgaacgtgagatttggacggagacacagatccaaaccatatcagatggcaacccaggaaaagcagatttcaggtgtactatgcttttctggggatagagatggacagaggcagatttgctcatttttggaagtcaagcgcttcaaaagaaattcttatcttgagatttgattcctgattttatcaggatcttacagcagacttcttcatggaaaagaataactgttggctaggcgagctgatgctgtgccgtgggttgctatctctttcaaattcctatctgcagtaacctctgtctctctgaggttgaaccaaacacatacttattttgagctgaattttagacaggtttagagcagccagaaaaaaagcagaaaagtgcccttcagaactcaaagcagataaaactttctgttatcccttacctagccgacgacttgagtgtagaattcactcagctgataaggaggctgacattttacctcttagaagttttgtcagataaaagatgtgcaagccatgtttaccatccactctgtgtttcaaacttttgataatagatttaaagaaaaaatcatcgagatacgaatattgtggtaaaataaagctaccccatagaattaaaataatgaggatcaaagaaaggctcaaattgttcaacatcctttaaaaggatccctttgagaaaagctgacttcttgacctatgtcattagtggttggtaaacaatttgcatggcttactaggattacactaatgttcctgactccagctccagcttgcagagagtgcaggtacagtcctattgagaacacatcttcatctctagagagcaaacctggcattaacaatgggagctaaatagaaaatcatggcatttcccatgaaaaaaagagtaacattaagtgctgggctaattgtcaagtggagggttggatatcttctccatttttccccatggttttccaatactttataggaaaaatgattaataagatatccaactccaagaattcagaggtccaaggagataagaaaggaaggcaagttggtttagaactcgtgtcttctacaggggatgccatggggggcagtggtgagcttaactgctggagatttccatggtgaatgtgcgtgtctctccttggcaaaacatgtagaaaagagacttttactattaattactttggtacgctcaagtatccttctcaaagcccttaaaatttcaaaaagtcctaggtttgtgaaaaatcatgcaattgatattggattcaatttatttgtggcgtatagacaaaaattcagatgaagaaatcgtaaaaaatacatggtgtttcacgcctgtaatcccagctctttaggaggctaaggcgggcagattgcctgaggtcgggagttcgagaccagcctgaccagcatggagaaaccctgtctctactaaaaatacaaaattagccgggtgtggttgcgttgcgcatgcctgtaatactatctactcgggaggctgaggcaggagaagcacttgaacccaggaggcagaggttgctgtgagccgagatcgcaccattgcgctccagcctgggcaacaagagtgaaactctgtctcaagaaaaaaaaaaaaaaaaaaaaaaaaaaaaaaaaaaaaaaaaaaaaaaaaaaaaaaacagtgttctctagaatatacttcccaacttctaagtacttcatttaactagttttagggaatgtttatttaactaaggtgatgcctgaatgccaacaatggcatccatacatctatgaaagaccttttactagtaaccttttaaatcacttctctgttgataatcaccaccctcttgtgagtaattactaggtcctaaagcattgtccatggattttcatatttaagcctcattaacaacactaggaggtaggtggcattaattctgttttattaataagttcaacaaaaacttaaagagtgcaagtcatactcatcagcaaggatgcctagctcacaagtggatgcatggggatttgaaccagggtctgaaaacttggaggcctaggtttctatgagggcactcttctgcctcccttagtggtggatggcctggcacctggtcctcaccacgaaatgcctgaaatgaagaccacaggcagtgggcacttggctgacaagtagcaacttgtgcaaagttgtgatatgtcatcttatcctttcagttttctcctgttgcctttcaaccacagcaatgtggccaaaacttacgaagcaggagttttatgacataaaagacataatggagtccctgtcttgacctggggaggcaggttagcttacagggaaagatacataatctttataagagaatattttcatgtgtgcggatagtaaatatacaactgtgtaattatatatatgcatatgcgtttgaattgtattctaatatatacaagaatatatataaaataatattgtatacataaaatatatatatataacgtgtgtgtgtgtgtgtgtgtgtgtgtgtgtatatatatatatatatatatttttttttttttttcttgaggcagagttttgctcttgttgcccaggctggagtgcagtggcatgatgtcggctcactgcaacctctatctcccaggttcaagcgattctcttgcctcagcctcccaagcagctgggactacaggcacctgccaccctgcccagctaacttttgtgattttggtagagacagggtttcactattttggccagggtggtctcgaactcctgacctcaggtgatccgcccgtcttggcctcccaaaatgttgggattacaggcataagccaccgctcccggcctaagggaatgttttcatgtgtgtgtatactaaatatacaagtgtgtaattatatgtatgcatacatatatgtttgaattgtattctcatatattaaatacatgttatttcagaaatggaaggcaaaataaggatattagcatttcctgaggtacgtaaaatgttgggtgctttgcacgtctgacctcatttattttacaacctacctacaagatatgcattattttcatcattccaccaatggggagtatacgggagatgctgtaactggtataaatgcacagaatttatacactgcagaaccagcatttgagttcatggctgtatttacccaaacctaccctttttcagtgcttttttctgtctgttgggcagggagagacattagaatgagctggaggtatcacagatggataaggtacaattgagagtttgtagaggtttctccagtcactttatataataaaaagcaaccagctatctcaagtcccagacctcccagccctatattctctgctttattttcctccttagctcttatccttatctggaatgttgtgtattaacttgtttcctccatctagtttataaatgctatttaggcaggggggttgtttcttttgttgctaggaccattgtacctaaagtagtacttgacccatcatagataaactatccgtatttgttgaaataatgatgccacctataatcaaacaaattcaggacaaatgaccaaaatttagtgtttatgttgaacaattatgaccatcaatgatcaatcatgaatgtggattacaatggaattttactttgaaaattttctaaacactagtttttgttttgtttttgtagcccagggaacaaaggagggcactgagagctgtgagtggagatagcaaaacaaaaaaacaaacaaacaaaatcgtctatttatcctgtccttgctttgggttaccatgcgaagtcattcattacttttagaaataattcatacattgctcaaaaaggatatcctgcgtgtttgatacaaagggcatttatcatattgaagcagctaaaacttttcaatcccatccattaactcacgaagctgcaagttactgcgacgctgccttgcccatctatttagtatttccaggcaatcatggtacagtacaaagcaatttgtttttatataatttccttcatgctcgcaaacacaacatgcatcacagggaaagccaatcatgaactaaagagaaaaagggatgatttaaagcgggagagtggttcatttgctttggggcatgagaaacaattatttcaagaggccagggtttctgtgggaagtcaggtgaataagaatgctagtgctggccggctgctttctcggagaaactgctttgcctaagtaacttcttcttttgagaggatttcttactgagccataaatgcttctaatgtgaggaaggctaaatccgcctcctataaacctgggagccatagttccatttctccccatctttcccaaagatcatctcctctaccattgaaggacaatgggaaatgctgccgcttttatcatacgtcctccatctgaaatgcacttggatttcagccacgtttgagaacctaatcttccaataaactcctttagctctatgagagatttccattaatttatttatttctgtgcttgtttgttttttgggatgggtattagctcatttgccatcctagatacctattttttaacttccttggtgttttactgacaaatataacttgtcatttatttgatttctgtaataagctgcaaagtacttatggtcccttttaagtgtagggcatggtgctgggtttaggcatggggatggtctcaggagactttgctggacctagagagccaggtaggatgggtccttaagcccaaatgcattgcttgtgggggattcaaagacttatctaagattcctttgaattcaaagggggcttgtatctaaggaccctcgatgtccctagccctttgttccctgtagtgtcacttggttatttcggccacaaagtctttgctacactggtttccataaaattcatgcaagcgaacggtgagtttaatccacgttgaggaagatctgaaggacattggagtgcccctgtctcttaaggcacagtccacatgacacgttcctgggctctggtgttcttcctgcttttcctgccttcagtgaagaacttgttcatgtcttcttttcttcccacctttagtctccttttctagaagcataaacacataaacagttcacgcctgtagtcccagtactttgggacgccaaggccggtggatcacctgaggtcaggagttgaagaccagcctcaccaatatggtgagaccccgtctctaccaaaaatacaaaaattagccaggcctggtggcatgcgtctgtagtcccagctactggggaggctgaggtgggaggatcgcttgaactcaggaggtggatgttggagtgagccgagatcatgctagtgcaccccagcctgggtgacagagcgagacactgggtcaacacacagacacacacacacacacacatagatatatataaaaaaaatagcaacagttttccgaaacatgtttcagagagcttttggcttctgttgctctctgtccatcaccagtctccagcaggacccgcctgctctccaccctatcttcgtttctttgtctgaccactcatcacctctccgcttccactctgagtctgcaccagtctcttctccacacagcagcgaaaccagtgttccaaaacgctgtcttgatcaggttgatgtccctgactgatagcttcagaggctcaaggtcaaacatctttcccaagatcaggaccaaactccttcctatgatctcgcaggcccctgccctcttcctctggctcattccccttctgtttcctcttcctgactgtatactagctgcaagagtctttcattcccttgaaagtattttgcttccttccatcacagagtttttgcacaggccgttcctgtacctggaacatttctcctccctcggtctcactaatctctgaaaccacttgtgtctgtagtctggtgatgcatcttcagtgtttaacaaaaattcatggcacttactaatagaagatgctcattaactactgaaggaatcagtgaatgaatgatcaataaatgaataaataaactgggagtcctgaggttaccgtcatcttgatataccagtgttcacataaggagacccaagtgctctgcagatatttgtcctaaaaagccataggtagttgcaggttattacaggttttcttcctctgacagcccagaggacataggagcctgacttcccagtagcaaagaacacacttagcatcctcatcttggtttctaagaccattctccaataaccccttcaaggtattgctgattacagatatatattctgtattctttttttattattagtatactttaagttctggggtacatgtgcagaacgtgcagtcttgttacataggtatacgtgtgccatggtggtttgctgcactcatcaacccatcacctacattagatatttctcctaatgttatcactcccccagccccccagcccctaacaggccccaatgtgtgatgttcccctccctatatccatgtgttctcgttgttcaactcccacttatgagtgagaacatgcggtgtttggctttctgttgttgtgatagtttgctgagaatggtggtttccagcttcacgcatgtccctgcaaaggacatgaactcatccttttttatggctgcatagtattccatggtgtatgtgtgccacattttcttcatccagtctattattgagggacatttgggttggttccaagtctttgctattgtgaatagtgacacaataaacatacatgtgcatatgcctttatagtagaatgatttataatcctttgagtatatacccaataatgggattgctgggtcaaatggtatttctagttctagatacttgaggaatcaccacactgtcttccacaatggctgaactaatttacactcccaccaacagtgtaaaagagttcctatttctccacatcctctccagcttcttttgtttcctgactttttaatgttcgcccttcgtattctatattctttcaactagaagttggtatatacaaaatgatcaggagcaacttctatttccaaaaactaatggagttttcacaaaacaaaatgggtgtaggtcaagaaaacacatgggccaaacttaaagaactcctaatgggcaaagctgaagcaatttaaacagcagaagaaagtagcattagattatgacccaaagtattaaaataaatattcatgagtcaatagtgatagaaataaatgcatggataaattaatacatggaagtagagaaacaaatctcctgtgcagaaaaatcccagataatgtatgcacagccttcatccttgaagaggtagagcatgattctccatctttaagcactgcttttacatggtggctttcttccagagagtacagcatggagaagggaaggaaagggagcaatgttgcaggggcaaaaacctgccaaaaacatcctcagccaacagatcagggtcacgtcagccagcatgtcacattaattgttggtacccttgatcacttaaccccaggagattgaggctgccgtgagctatgattgtaccacagccctccagcctgggcaacagagcgagaacttgtcttaaaaaactattaatatattgggagaaaaatgctattttccctctgtggttttcctccccatacctataattccagtctgattatgaggaaataaacatcagatcaattcaaaattgggggacattctgtaaagtacctgagcagtacatcttacaaccgtcaaggtcttcaaaaataaagaaaaactgtgaaatagctgcagccaagagaagcgtagggagacatagcaagtaaagataccattaccgtggtatcctggatggaatcctggaacaggaaaaggacattaggcgaaaaacaagggaatcattccaagtgcagactttagttaataataaggtgtcaatatcggtttattaatctgacaaatgtccccttccaatcaaagatgttaatactagggaaagtgagtgtggatatgtgggaactctctgtactctctctgcaattttttctgtaaatccaaaagcgttctaaaaatgaaataagtctatgaaaggaaactaaaagccacaggcaatcactcctccagcagcccggtaatggattcccccttccccgtgccctgggccaagactgaactgtgattctgctgtcctgcacccggggacctctatttggagcagtatttggccaagggaagcagcgctcactctccccagtccctcccctcctgccctgcttgcggattttattttagtttgcttccaatggcactcagctgctgctacaggcaaatatctggctgctttgcacgctattgtacaacacactgggggaaaatgagccttcgtgctagagtctgggtccctgagcaaataaacagagaagaaaaatggtgcatgtgggggtggtgaggttgagggagagactggggagccaggtgattgagaagttagtggctaattcagctcagagtttgggcagaaatcctatgcttctccccattcaattttccttattccccggactcctcagaaacacccagcttattggtgggggtaaagagggtattgttttcctgggggtttctgttccaaggataagggagttggaaagagctgttgagggtgtctagccttttttactaggtggaggtcgtctgcacaagcgctctctctcttgcttgctctctctctctctcgctgtctcgctccctcttgctcccgcttgtgctctctctctctctgtcttgcttcctgctttctgagttctctactgagagctggacacagatgcagtggctcatgcctgtaatcccagcactttgggagtcctaggcgggtggatcacttgaggtcaggagttcaagaccagcctggcgaacatcgtgaaacaccctgtctctactaaaattacaaaaattagccgggcgtggtggtgggtgcctgcagtcccaactacttgggaggctgaggtaggagaattgcttgaaccctggaggtggaggtttcagtgagcttgagctgagatcgtgccacttcactccagcctgggcaacagagcaagactccatctcaaaaaagaaaaaaaaaaaaaaagaaattaatggggccagagacctttggaaatttcaatggttgtgtcaaagcaacctgaagtttcggcttcatcaacttccagaaccctttgagagtgtaaaggtgaagaggaggctctgaggctgcctggatgtaccctccaactgtgtggctttgtggaagtcgtttaacctccatgaacctcagcttcctaatgtgcagatccatgaaacactgacacctccttcatgagactgtgtaaaaattaaatgtatcaacccatacaagggacttttaacagtttctggcatcatgtaattttccagtacatgttacccctcctccaaaatcaattatgtatactttaatatgttaagtggtaacatttcacattttaccttctcttcatgtaaggaggtggagagccattgtcaggccttgtctcatcttagaaaaagattagaagttgccagcttcaacataattgtcattgagagggcttaaattttgtttggattaataattcactaattaatcccatagataaagatccagctgaagagtctcattttttcattattaacaatttgaatagatttcatttattgagcaattactatgagccagattctttacagagtgcttaaggtgattatgtctaatcctcccaacagcaggaggtagatactattattcatttcacttaccctaatgtcagagaggttaagtgactttccaagcttgcaaggctagtaagaggtgaagctggagtttggaacagggtttacagagtccagagcttgtctcctgatggatatgctacattgcttctgtttgtgaatttagagaagagtggtttaaaatatcttttatctctctgtttttatggagagaggggagaaagtgctgtttgacgaagatttattgccggagggacatattgagttcgaaacatgaagggtagcaaagctgagattctggcatctgttttcttgcttgtttatcccattgctctgtcggcgcctatagaaggtagctggtttggtttgagttccttccaaaacctggctctaaggaattaatccctaataacaaatgctcagcttgttgttgaaagggtttttgtttgtttgtttgtttgtttgtttgttttgagacggagtctagctctgtcacccaggctggagtgcagtggcacgatctcagctcactgcaacctctgccttccaggctcaagtgattctcctgcctctgcctcctgagtagctgggatgacgggtgtgtaccaccaggcctggctaattgtttgtatttttagtagagacggggtttcaccatattggccaggctggtcttgaactcctgacctcaagtgatcctcctgcctcagcccccaaagtgctgagattacagatgtgagccactgcacctggcctaaaaagggtctttttgactgttggtgatcttcattactcggtgaaggtggagactttcagccacctgataggaggatttgcagtgacttgtcttaggatgggagcacattctcataatgaaagacactcttcccaaaatgttaattcttttggtagccacatgcttgtgttaactattgctttgccactggtgtatggatacaggaaaaagcacttgaaccagaaaacatcagaccaacatgtcctgcaatgctttattcctattgctggatgtttctgcaagtaagtcactctaccaacctttcgagcatctactgtcttccacgaagggatcaggcgtgtatataagccagccttatacttatacttatacacagccgacttactgtgtttgcgacctggcatcatctaagtcaaaaaaactttggtgatattaaaaaaaatgccctcaaaacaacttaatagtatttatagaaattataaagcttcatccagtgcctaaaatgaacattgggatgttagatcattaaattaatgggatgtgatctatgtcctccgtgatttcaaaaacaccattcttttaattgttaattagagaatgtagtgattacagaacgtgaggaacaattttgcttattttcaatatgctggttgtgattatgtgaattattaactctgagcagcattcaatttcgttcatttccatggctttatgaactatttccagtatgcatctgttcttgttttcaattaaaaaaaatatagatttcagcctgtaccttgtaatgaaaataggaagaagcaggaaatgaatttcttatacatcattgtgtaatatttctttatagatttttttttttccaatgtggacctgcctggagacctgtccatgaaagatcatgaggtgccaaaattctcgcaagaaaaacttggactgttattggctatatatttaatactattatacttgcactgcagggaccaaaagtttcttatcaaatttattgagatgattttaacattctgaaacagattgtccacactatatttggaaaaaaaaatgtccaagtgatagatggatttacagcttacacctcaggtttttattatagttgacatttacacagtcttgaaagtctctactcctctgttttatagaaatggcaatgccactcagtctcatccaatattattatggagctgtaacactctggtgaaggatggaccatctattacttgacaaaccctttgtcaagtatatcatgccgtttcagaattatctgaaataatcatcacagaaattcattgacccatcttatgttttgcgaatgtatgctcgaatgttaagaagctattcatttgtttttctcagatgactaaggatggggccatgtgccacagagctccatgtctgcttttacatagttatcattgtgaatggcgccccctacagttgttcagtgtgtagtctgaaattttggagaccctgagtttcttgacattgtttgagccgaagaccgttatctttacttcaggggtggtcctttcacatcttttttattttattttattttattttatttatttttaggcaggtaatttttgcatttgaagagactctgaaatgaccaagctgagccgttgccattaatcctgtttgtctaaaagtttaatcttgagccacccctctcagcaatgcattgccactttctcatacattacaaatatgtaatatgggcaaagtaacgaatgtcatgttatcaggttatgtgtctcaatcactgaaacaggctcaaaaggaatgggacccagtgtcgaggagaagaaaggcacagaggaaagattctgacacttgaagcactgctcagcagggcaaatttggggaaaagatgtagacaagaactttagacaccaggaacaagattgagaaggtgctgagaaaagatcatggctgggccaggcgcggtggctcacacctgtaatcctagcagtttgggaggccgaggcgggtggatcacaaggtcaggagttcgagaccagcctggccaatatggtgacaccccgtgtctactaaaactacaaaaattagcctggtgtggtggctaatgcctgtagttgcagcttctcgggaggctgaggcagaagaatcgcttgaacccaggaggcggaggttgcagtgagccaagatcgcgccactgcattccagcctgggtgacacattgagactctgtctctaaaaaaaaaaaaaaaaatcatggtcaatcattcttaaagctggctaattagtgttacctggagagctttacaaaccccctaccttatctttataccaattgaatcagaatgtctggaatgagggcacaggcgtcagtgtattttaaagatttccccagatatttcttatccacagccaaaattgagaaccactgggctggaggagtgctagggaaggaaaaggaatacaggatcaaaagaacctttcatttgtttattgatccagccgtttttgttttttttcactcattcattcaacaaacacttctcatgaagtccctgtgtgatatacactgttctatgatttgaagatacagctgagaagaaaacaagcaaagccttcatgctcaaggagcttatgttctagtgtcctgaagcaaatcctttctgactcaatagaaatcaggttcacgtggcaattataacacatgacctttcattaaaagcatgacagaatcattttcatgagattgttaatttggaccacaaaacaagtcctgcccaccccacgcccccccaaaaaacaaaattaaattactaaaatttgatgtaatcgatgcatatcacatctatttgtgaaacactgctgtttctaatgcccgtccttcctctaagtactcttcaccttcatttgcctaattcttcaggagtaaacttgtaaccaaaggcaaacatcttacaaatttgatgatacttagacctgcttcccaaatgcttgggaagttttcataaaattgaatgtacataaataatacatggtcaggggttcggagacttaggcaaggtgctaaatttgtccaatatgaggccacctgctcgtatgtcatctgttggcactggctcacgcatttgtgtgccaggacatatgaaattaagtttacctgatgctctctgacagcagctttctgttacaacgtgcaaattagattaggttaaggtagagggcagagtaaatggatggcttcatagactgatactagaatcctgacggctttaaccagaaggtgactggttctggtctagcttgggtcattggtaatcacaagttcctgttattgatgcctgtgcagtggcctgtggggagatggatggcttattttttattgaattttgccgttatagccaaacatcacactggcagtgcaacttcattgaccttcaccctcgaattcgaggaaggaaggtcgaggtgtaaacagaggatggagactaaataaggtagttgtctcttgaatgttgcttggtcccccttctaagtgtgtgatacatgagcaaggctaaaaggttgtacagcctgccacctgggaaccacctcccttgggctgaagctggcatgattacttgggtcttcaaagcaggcgtgcacagtttttctctcaatatgaaatgatctaatgcaaacttgaaattctaccagaagaatcattttttaactttaaaggaatctagagttgtctctgcctcattaagtaactcaattggcttcaaaagcattttttatttatattgaaaatatagaaactgtcaacttcatcctaattttgaagactttttttctataatgtggccttccgttgtgtagtaaacttagtaaagcacctgttgtacaactcaatggcattccatcccaagggatggtttaatggcataaacgaagggccgagggaaaaataaattcagatatttaaacagactaggcaccataccctaaatctttgcttgcaaagttgaccagtgatgcacagaatgaggcagaaatactgtcaaagggactggagactgatctcgagatgttctagcgtggaatggatgggtttacttatttgtttaaataattgcgttctttggaattgcctaaattttgcacttctgccggtttaaatagagtcgaattgaggttgtttctggcaagaatgagtgtcacatttttgaagggaacagcagtgacagcacaacaacagacagttcggagactaaataccattttttaaagtttccgaagattaaatagaaaaacactccggggcttagctaaaaggctaacaggagaaacgaatttcacgtagaaatcaatcgctctgttcactgacacccagtgacagaactaataattgtgtccatgtaaaatcagaccctcttgttactttttaatgaagtctgtctgattctgtgatatttttggcctaggaaatgaaagagatgttttattaaatgaaactaggtctacataggtgaagtatctgaatataactatgtaatcatatcgtacaataaaaagaaaatataaaaaaattggaaagacatgaatgtagttcaaataagcttatccctccaagaaggcttctccgtgttttcaatggaatagtggcctgtattttgcatttgaacaatggcacaaagccattggaaggggaagaaaggtttagcctacccctcttggatccttatgccacaacgtctgttccctgctgtactgagaagtccaactctcctttgcaagccaggaaaaataggacctttttcaaattgcatgcttcgaagatgctggcagaattcaaaagtgctttctccacacagtataaagccctttacctgattaaagctggttatttggcttgccaaggtgaaaagttttcttatgttttatcttgcattttccctctcttcttccctcatttcctctcctcttcctctttctttctttctcatcttccctccaacattaaagacatttggtgcaacctcagcattattatttttaacacccaccttgccaagaagagtataactccaaggaagcttcttttttaagcagacctcatctgttctctgttggtccctgagtggtacctttcagctggccatttttccccagcggtgcatgtgaacacatgtgcgtgtgtgcaggcatgtgtgtacacacactttcatgttgatggagacatatggtcatatagaggatctttgtggtccatctagttctttagtttcaaatgtgatgtgttttatctaatatctgaaagggaaacatctttctgtgtaatttctcaccctgaattacacatttaaaccccacaaatatcagaggacattctaagaaataccttgtgggtggaaaagttgaccttttgtttccctctgcctggttggctgacttgggagagagtaactgaaggcaaagggaatgtcagagtggaggaaattcccatcctagactgggcgaggggcagggggtgtggtccttttacgatattcacccaattcagagcgccctacttctgttcaaaactgtgataagaaatatcaatatgggcatatgacagtatgtgtgggagggtacctccttcacttgtagcatctcacagggagaggtcttggcaaaggcacagtcatcaaaactgatgagcccaaaatgggattcacccttaaaaaaaaggttttgataaaattagctttcctcttaacaatctgggagtgctatcagaatagcagctataaatctgtctggtagggccctctcttcttaaaatagatggatgggtagatgaatggatagatgggtagatggatggatagagggacagatggatggggggataggtggatggatgagtaggtggatgaatggatgggtggatggatgtttggatgggtggatgggtgggtggatggatggatggatggatggatagacggatgagtggatgggtggataggtggatggatgagtagatggatggatggatgggtaggtggatgggtagatgagtgaatggatgggtggatgggtgaatggatgggtgggtggatgggtaggtgtatggataccttggatacatacatgtaatacatttaaattcttaataggtacatcttatgctcttcatgtctctttctctggggaggggcactggggtgctgacatatgctatctttttttgtggttaagaccataaggatgagaccacttcaccaattcttctaggcatgttttgaagcaatgtggtatagtggaaagaacacaggatttgaatcactggaagccagatttaggtctgagcaccatgtgctttttagcttgagtacctttgctcaagatggttaacctcagtatccatgtctgtaaaatggaaaaatgttttctaacttgctggattgttgagagaattaaaagatatctagatctaggcagatagtgtttaactcaatacctagaatagagagagcattttgattaatgggagctacagctactacttcaactgctgctaaggatctttcttgtttttactttcccctccttctctgggtgttttttttttccacgatacattttagaaatagaagccacattctaacttctttggctccttgcctgactttcatatggtctctggtcgagaatggtggccattctatgtgtgtgtgtgtgtgtgtgtgtgtgtgtgtgtgtgtgtctgcctgcctgtatctatgtctgtatctagaaaatatatatttatacctggaacatatgtacgtataaataaaattctggaagatgcatcttgctggaagatatatgtcttgatatgtatatctggaaggtatatatcttgtttttcccttgcttttgacagatgttctaaactcaccataccttttggatattgaactataaagacttctacattcctattttatacatttagaattgtgaatattgtaataaaaattcctctgacatttctcacatactacagacatcatgtcccctactttttcttcatggagagatatgagacaatgttgaacaacccagaataagccaaaatataaggaggtaagaatggattcgttgtctgaggctcaatatgacaccacctgaattttctctatatcacccttcaagggggtgaggatggctaagaccactgatacttatgtcatagcatgaacaaataataactacttaccatgtgccaggttcttctgcaggcactttacatagataattttatttaatcttcatagcaaacttagggagtagatgctagtattatcccaagtttacagaggaggcaactgagtcacagtaagctgaaatgacatgctccaggttgcagaatgatcataaagcagagccaaaattaggcaccagtgtcttttggtgtcaggaatctctgcttttgtgcttttctgtctcatgaaaatatcagagtggctctctctattgggtctcattattgcatgccattgtgggttcttctgactgtgtgtcacctttcacaaggagcatttcctacactgtgaaagtgcacatgacaattttatgtacttcttgttgaaatccttgtcttccttatgctgcccattggtgcttcacactattttcttcctcatcccacttccgcagcttgtagctcctgcctgagctttggaagtgaaagccaaagttccacctcgatgcaggtgataaaactagggcaaaatgaataaagtgagagctttgacgtcagcacgtggaacacatacacaggttatgctgaattgtaagctggacattatgtcactgtaggtttagcccttcttggattttctttgtttgtttgttttgttttgttttgttttgttttgtttttaaggtgtagtctcacaccgttgcctgggctggagtgcaatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggtaaagctaaaattgtgaatatgtaaataaaaataccatgagaacatgggagagggagctggggtgttttgctttcataggatgggagccaatgcctacatgttttctattgtatcttttggacaggtagaatgattgcaattgttaaaaaaaaaaaaaaatagggaaaatgatgccaggagcagaaagcaaagatgttttcaaagagtcagaaagactctgttccaaccacaaaccatcctatcttcccccagttaatggggttgcctaaatcgtcaactcctactgtgaaactcaaacccttgttgttccaacttaactttttgcccacagagtagtttaggacaatccaatgtcagtatggcaggtagaagtagcacaaagtaagatccatttgtgtcttgatttgagggacataaatgtcctattttctttacgtgtcttggtcaccccctcacacaggctctctgaagttgtttccgtcattttgtacccttcctcttcttctctttgtaagcttaagtttcacattcattggctgtttttctctctgaggtttcagcttcaagggattatgcatatgagacttgtattatataccctgaatgaaaaatattgaaaatatctcacagctagctggatctctcttaatccaggctttccagaaaaatggtgctgggaccacccctggaagctcagcctgccccaaaccccaggaatcttcagtctgcaagggcagaaccagataatgaaatggcatgctagcaggtagtagttctctgatctaaccactgccacacataaaaaatgctgcagctttgatttgggttttatgtcctgtgattacacggatcgtgctggttcctaatgtagacctttccagttctctgggtgtgcacctctgcatccacatctccttccaattcatggaacctcctttatttcttccctgcctgtaattcttctgctctatgatctgagcttccactcatgcccttattatttagctcttacattcctagaagagtatatgtttatctattttaccactttgggcattgtcatatgtcataggttcattcaccattcattgaacaaatggttatcaattagtcatatgtaccagtccatgtttacacatgacaggcacatcaataggtaagagaggaagagcccatgccctctgtttcaatgttggtagtaacatggcttgtgaaggttaaaagaaaaacccagaagcaacctagtcttgtcatcaaaatgagaaagtaaagatggattgtggtaaagtaacgcagtggaatactacagagcagtgaaaaataaaccaggacgaatctcacaattttagtgttggaaaaaaggaacaataggatgtgttatcctcacttgtgtaaaattgaaaacatgcttgtgtaaaattgaaactatggaaaataatgtgaaacaaattagtatatttcttagggatatatgtatatatacatgtatgtatgtgtgtatatgtatatatgtttgtcagggataactaagggattcctaatctattggtagtatttactaacttgggcataggaagcagatacatcttgtattaagtaatatactgcttatgtgccttaaatatctcattttaattttttataaacaaaattgatatgctcacttcaaattcacctaattttaagggattgaattattccttagatgtattctgctgaacttgctgggtcggatagtgtaaagattgaaaggattgatttaaaaaatggaaaaacattgtgaaggaaaaagaaaggaggcattgtttgagaacgtttgtcttagacatagcatctctacccaacagtgcaaccactcattattcctagcattgagggaagaatggttaattttggtgaaagttctagttcatatgaattcctctctttagtcctaaagttgttgggagtgaagagatctttccatgtcctcgagggctggtaggaaaaatctgtgtcttgttactaccatgttcccccaccatctttcctttataagttttaattaccctccaacctatacctcatgtaaagtttttcactatcacgcattttctacaccttctatgtacgtaaatacacatatatttttaatactcttacctatcttagtgtcagttccagacatgttgcctggttaactttgaatacttcagtgtgttcctaaaaacaaggacctaaccacaatacaattccaaaattaagaaatttaacacactggtatagtcctctggtctcatccacagtttgttttccaatttcatcaattgtcccaataatgaccttgatggcagttttgttcatggtccagaatctaatccatcatgcatttcatttagttgtcaagtctctttagtgtcttttaatccacaacagtgacagtcttgcttggtcttttatgatcttgacatttttttaagaacacatacgctgggccgggtgcggtggcttatgcctgtaatcccagcactttgggaggccgaggcaggcggatcatgagatcaggagatcgagaccgtcctggctaatgcggtgaaaacctgtctctactaaaaatacaaaaaattagctgggcggggtggcgggcggctgtagtcccagctactggggaggctgaggcaggagaatagtgtgaactcaggaggcggagcttgcagtgagccgagatcatgccactgcactctagcctgggcgacagatagagactccgtctcaaaagaaaaaaaaaaaaaaaaaaaaaaaaaaaaagaacacaccctggactgcccattgccgaatcacctgaagagagcccttcaattttaactaatcatttttgcaagcttagttgtttcagctgctacaaaaaagcacgagtcttttaaaaaggagtaaaattctgacacgtgctacaacatggacaaaccttgaaacattacgctaagtgaaagaaaccagtcgcaaaaggacaaatattgtatgattctacttatttcaggtacctaggatagtcaaattcatagagacaaagtaatatagtggttcctagggaccagggggaggatagaatggggagttgatgtttaacgggtatagaatttcagttttggaagttgagaaggttttagaatactgataatagttgcacaagaatgcaaatgttcttaatgccacttaattgaatactttaaaataattaaattggtaagttttatgtaatgtatattttgctacaattttttacaagagagtgggtcctcaatatgtaaatataatgtcaattaaaataacaagaaaacacaaggcagttatttactttgtggatgaccctcaatttgggtctttcagctgtttctttatgatcccagttggggtgtgcatttttgccagggatacccccaagtaataatgtcctgtttttcccagggtgccatattaagagacacatgatattagtttgtctattattggtgatattaacatcagtcctttggatcatatgatgtctctcagatatctccagtaaaaactttctcactgtaattaatacatagtttgggggtgggaggaatggttttagacttttaaaataccgatttgtcatcaatccttcattcactagttttaccattcattgatgattcttgtctgagtcaattatgattattacggctatcaaatgatggttttctaaccccattgcacttatatgtgtgggttggcattctatttcctttcctatatatatacatttaattacttatttcagtataaagtcatggattcgtgtttttattctatgaactacaatcggttactttcgttatttgttttgatgctcaagttgtatcatatgtattcactgggagccccttcaagctggctcctgtatcattttgacataaacccgtaagttttttttaataacatccttattccttggcaccagaagatattccaggtatatcttgacttttcttgccccagtcctagagccaggaggccatttttccacagagtaatccttcctttgattggagagtggtgtttagaaacaaagttctgggcgattatggcttctggaccctctaaatagacaatatagatagaactaggaaaaaatacacacatgcacatacacatgtatatataattatcttttcaaagccaagaatttgttaatccttcctaaggattatgttcttcccaacaggatacattatctaggttaaaatttccctgcctatctgatatcacttgttattacgagttatcttttatctgtctgttaggctgtgagacccttcagaagagagacttcatattttttgtcatctttgtatccccattgcctaggaagatgtctggtacagattaggtactaatattaattcataggattgttgggtgaaacgatggttgaatgaaaggatggttggttaggatcattgggtaggagggtggatgggtggagtggagattcgatggaaaagtatagttgggtgggaggatagttctttgggatcctgggtaggagggttgttgggtagaatggagattgggtggaagtatactcggatgagagggtggttggtaaggatctttgggtaggagtattgttgggtggaatagagattgggtggaagtatactcggatggaaggatagttggttaggatctttgggtaggaggatggttgggtggagtggagacttggtggaagtatagtcggatggaaggatggttggttaggatctttgggtaggaggatggttgggtggaatggagaattggtggaagagtatagttggatggaaggatagttggttaggatctttgggtaggagtattgttggatggaatggagattgggtggaagtatagttggatggaaggatagctggttaggatctttgggtaggaggatggttgggtggaatggagattgggtggaagagtagagttggatggaaggatagttcattgggatcactgggcaggagttttgttgggtggaaaggagaatgggtggaagtatagttggatggaaggatagttggtgaggatctttggataggaggatagttgggtggaatggagattgggtggaagtatagttggatggaaggacagttggttaggattgttgggtaggagtattgttgggtggaatggagattgggtggaagtataactggatgggaggatggttggttaggatctttgggtaggagtacggtcgggtggaatggagatttgatggaagagtatagttggatggaagcgtagttggttaggattgttgggtaggaggattgttgtgtagaatggagattgggtggaagtatagtcggatgggagggtggttggtaaggatctttgggtaggaggatggttgggtggaatggagattcagtggcagagtatagttggatggaaggatagttcattgtgatcactgggtaggagtattgttgggtggaatggagattgggtggaagtataactgtatgggaggattgttgtttaggatctttgggtaggaggatgtttgggtggagtggagattcagcggaagtgtatagttggatagaaggatagttcgttgggatcactgggtaggaggatagtgtagaatgaagattgggtggaagtattgtcggatgggaggatggttggtaaggatctttgtgtaggaggatggttgggtggaatggagattcggcggaagagtatagttggatggaaggatagttttttaggatcactgggtaggagcattgttgggtgcaatggagattgggtggaagtataactggatgggaggatggttggttaggatctttgggtaggaggatggttggtggaatggagattcagtggaaatgtatagttggatacaaggatagttcattgggatcacagggtacgaggattgttgtgtagaatggagattgggtggaagtatagtcggatgagaggatggttggcaaaatctttgagtaggaggatgattgggtggaatggagattgggtagatatacagttggatggaagaatggttttcatgcaagagcatttgggttaggggatggttggatgagaggagttgttaagtggaagaattgtgacgataaaggatcattatgtgggaagacggttgtgtgggatgtggtctgcatgtcttatttagcaatgtatgtcttttttgttatacttctgtactcattgcattcaggtgctgtttaagaagttattttggttcctttttgtctttcagatagtaggtgttcattcagtatctattgactgtgtgactatgactttcaggaacaggaatggatgatttatctttcgattctttgcattctccatagtgctcagcttggcgtaaatacagatttaatattcagtttgacagtaagtcagttagaaaaccacagcaacataatatctgccctatttaccttttaaagaaaactaaggatgctgtattagtttcttcaacactgagtgtggacttgattcattgtctctggatattcagttgccccaaaattattcaagtagtctacttggcaagtatttcaagaatggagggcattgtttagccttgtaattattcattggctcatgtaattaggagacaaacttttgctttggaataagggttacaccacacaatttgggatcattttgtgatcaggcaattgaataggctagaaagaattcctttactgatggatagacattctgaatacctgttttatccttttctattttctcatactaagaaagtaagtagcaaattcttctcacactgatattgtgaacagaaaggaactctactatttttggccatatatatgtttttttaattttggatctattatgtgttctagtgtctttagagaaaattttcgtaattgaaccttagaagagaagacaaatgctgtgtaatgtacataagaacaagaagacgttactctagctgaaaatgtcttttttccacagtactttatatcctggccaactgctcttgtgcaaggcgaccaagtaacattttcccattcagctataagaacgaagagactgttattgccactggctggtattgagtaatcgtacataggtggggtgagttgaaggcaatctgaattataaaacaccttcctttgaagtcaaatcaatttttattcttaatctgtgaacatgagatgggaacaaataacttctgagtgaaataaagatttcttagcctgtcaagatttatcttatcaggctgaagaggtgggattcctgttagcaactggcagttttaaaaatccattcgcctgaggaagtgtgaaaacagtctgcagaacaaagacactgagctattgctgcattgagtgcttatttgctccttttttacatttcctgcttgagacctcgccaggtccaactttaaaacgtttgcaggctaatgggagtgtgtgcacagggagtatcagaaatcatttccttaggggaggaggtgttttgtggtgcaaaatgttgaggttctgttgccaaaacaccaactgcaagagggtattttctgtgaacttcatgggtggctttcatagggaattctccatgtcattctctgatgtcttttattggcccttgttttgccagagtggggaaaaaaaacaaaaacaaaaacaaaaaccaccttccctgtgtcatttctcttttaacaaagaaagccaaaataattctataaatgaaagtcatgcacatgtagaactttgggtgcagctctagagtattttttttttttaaccctcctaggatgaagccaaaagaagaaaactggttgtatttctctaacatttttaggcagatgatcgtttctgggcagggggaaaatgccaaagcctgtgcagtttctctttcggctcatttgaaaatactctaggaaaagacccctgtggattctctgccccttctgtaatgtgtggaatcatgtgattgctggacagcccccttggaagcctgccagcccagcctcttcagcatccagatgggaacccggaggcgcatctcacagcggaccgttgattaacccaaggtcacctggctctggtttctgacggagcgagaatgagtacccagaggtttccagaacctcagcacaaagggtatccatgatgaacaggcatttccctatcccttctctctcctgtcccctgcataaacaatgcaaaaaacacactcccttcttggccaggacccaaagacctattatcctacacatgtctttctgtgctttgagggatcagcaggggtgccagtgaacttggattactctttggatcaccctgctgcctccagctccccctctgttttgtttcatgactcagtcatcctgtttgagctcatttaccacttgtataggggtacattccttgacttctcagagcaaaccaagcccccatccatgatttcttcttcttttacaatgagctctcatatcacatttatcccagtggaaatttcatatcaatatctgtgattctttgactgttctctctttcccctagactccaggatccttgggatcactggccttgtcatttatgttcctgcttatgtcctatagcctggcacttagtgaggcggtgtgttgtgttgggttttgtttgtttgttggttggttgttgttgttgttgtttgcaagggcccctgcaaagtatcacaaactaggtggcttaaaaaagcagacatccattctcttgctgttctggagcccaggaggctgaaatcaaggtgttagcagggacatgatccctctgaaggcattaagggtgaatccttcgttgccttttccagtttctggtagttgctggcattccctggcattctgcggcttgcagctgcgtttttgaaagctgcctcactcctaacctctgtttacattggtgtctgttcacgtcacctgtcctctatgtgtgtatctctgtgtccagattttcttccgtttgtgaaaccagcagtccttggtttagggcccaactaatggtttcatgactcctgtgttagcttcctagattgcagtaagaagtatcagaagctcagtggcctaaaactacagaaatgtgttttcttacagtgctggaggctggaaatctgaaatcggggtattagcagcgccatgcattcttcaaaggacccagggaagaattcttgctttcctctttcagcttctagtagtcgttagggatctggcggccctcagcttcgagatgtgtcactccaatctctggcttgggtatcacatagccttccctgtgtttttctctgtctccaaacttccttcttcttataaaggtattggtccccagactgggctcggtggctcatgcatataatcccagtactttgggaggctgaggcaggtggatcactttgaactcaggagttcgataccagcctgggcaacatggaaaaattccatccctacaaaaaaaaattaaaaattagctgagcacggtggcctgtgcctgtaggcccagctacttggaggctgaggttagaggatcacttaagcccaggaagtggaggttgcagtgagccaaggtcatgcaactgcactccatcctgagtgacagagtgagaccctgtctcaaaaaaaaaaaaaaaaagaaaaagaaaaaaaaaggtatcagtccctgtatttaggcctcatcttaattccatatgaactcatcttaattacatctataaagaccctatttccaaataagcccacgttctgacattctggggggccatggatttctgggggttgttatccaacccagtgtacaaggcagtacacatttattgaatgcatgaatgaatgataatgctctgggccctggcaagtctcagcctggagaactgagtctgcctgcctgcgtagaatcaagaacaacatgcacttcagtggaatttgggaagggtcagggtctgtgccgacagaaatggaaaaatcctccaagcgcctcaccctctcttaaaagactcctcaagattgctttgctgttctaccctctacagtgtttttaatatgtctatttaaatgcaaattttgactttctgtctgtaatcatataaaatgtttggcactaaaattttaatcaggaatgtaattttagatagaggcggtaatggagtggtaggccacacataacagaatgaagcttccccaacgtggattcccagactatggaagtgctggcctccctgctcccagctgagccgggaaaactctgccccactccaagaggtgcttctcaaagatgattcctgatcccaggcatgtcctgtgtcctgtcaccaatcctggtgcttcatcgtcctttaaaatccaaacgaggtgatctagtgttcttcctctgcgtcctctggtcttctagcatcctggataggccgtgtatgtttagaaagaggggctccaccctgtgcccgcctaagatgatggctcatttatcaagaccaggctggaggctcagctaccagagcttctgttgtttgggaggaaggctgccagcagcagatgtttgtcctcgcctcagctccctgcagcctttgagctccatctgccgcacactcgggcacagctgccagtgcttcccctccgtgctcacctttcacctctcacggaggctggggtttcatgcatctgggcccaacagagagatggtgacccagaccctgcgatcctggtgccacaatccttcccaacagctcgctgggcatctttctgcactagcctgtcagcatgctggaagcagcaccgatggaggttgttgagcagggttgcaattgtagcccgtcactttggtcttggtgttccatcttgttagggcaagagagtcagagcacacacagccatctcctggctggatcatctggtggagtgggagtgtgcacatgcccacccccatttctaaataagatatgcattgtctcagggcctttgcaatgtccactccctagtcctcaatgctcttccccattggtcatcccagagctcatctcaaatgtcaccctttagaggggcagctgtcagtcttcccagttaaagcatatgccaaccccctcatcactcctggtctcaacaacctctttatttccctcattgctattatcttcatctgtaattctcatctttataatatctcttgaatgaatctttaggaggattactcttcctagagtgtgcaaaacggattgcagggatggtgagaggtgggcggaaatgttggaaaggggacaagggtggaattggtagcactgatcttgttgagagaggattggccctggaaaaagaaagtagcaatggagcaggaagtaattagacatagaagagagctcttcacgtgggaggtgaggagaatcggtgttgggattgtgtgttaggactgaggaaggaggaggaggaggatgcccagctttctaaactgggtatttgagtggatgggggtgacttgccgaaaataaagaatggtttgagaagaaagatgctgtgctcatcttggaaatgttgagttttgggcccctgtagaagacccagctgagatttgcaggtctgcatcaaatggagaattcatcagagaggcaatggtactcaaaaccatgacagtgaaaggtgcttccctaggagagaggcaggataaaaaaataaggtggcccaaaattaggatggccacacatcccagttagccaggatattcctgccttatacctgttgttccaccataatttctaatggcccccgcccccctactttcactttcacttgtctcagtgaactatatcgtcaccctacccgcatgagaaggttggggaaattcagagttcataggagggcataagaacccactgaaaaaaactgagtatgagcagaagggtagaaagaaaaaccggggtagtgttgggtaatgtatgccaagggtagaaaattgacaagagaagaatcattcatgtcaaatgggtcacagaggtgaagtcatgcaagtgtcaagagctgtgcattggatttagctaccaaaaaaaaaaaaaaaaagtcttgatgaccctgtaatcatgatggtgggaatatgccagagacaggtggctttgaggagaaaatcattgatgagaaactagagacagtcagttccactaagttttgttgtgcaagaagggggatatgttagaggagtttgcagacgggcatgagagaacaagagaaggttcatgggatgggaggcatttgagcatgcgtcagtcctggaaaggggcctgatggagaaagcttcaggagagggggtgtccacatgatacagcagtgttcccaagggagagagagcagatgcaggaagggacaccttccctgttaacaggcaagaaagagcaagttggggtgtaaggaagtccgtaggctttatggcggggatttgaagagagtagcatttattttctcctctgaggtaggaggcatctgagaggtgggggaggttgaagatgggaggaaagtagacagttgctttaaatagccacatggaaaatgggagaaggaattggctcattcagatgacttttattgggtgccttctgtgctccaagccctgggaatcaactagtgaagaaaacaatccaatgggactgatgttctccttggaaagagaacagtgacggtggtggaggcagcaaagggaacactggaggctgaagacccctccccaacttataatgatgcgtctgtgagtggtgaatggtggggattttttttttttttttttttttttttttttttttttttttttttttttagtagaactcagcagcttgggtctagacacagagaaaatggacaacttatggtctagagatggcagcacagaaaggaaggtgagttgaagttctggggggaaaataaatggcaggtaaagttatggaccatttgatcaaatcctggtgtgaaataaagagcatacttaggatatgtcttttgttttttcttcttttcctctgacatgcattgctatcatgagtgtccttgaacaaatctctttgggggcatacaaaaccatttctgtaaaacaggtgttaagtataggaactctgggtccaaaggagaacacataatcaatttggataaatattgccaaattgtctgttgcacattcctcaccagtttgtgctgccttcagcagtgcccaaagcgcctccttcccttcacataccgttgccaacataggccattatctttctgagttttaccaagtggaggaacaaaccaaaggtcctcatatttttctgtgcattctggtgattgcttgtcttggcgagcatcttctttttaaaataatcttgctgggggacttgtggtatgcaatgatgactgtggaagtattttagggggcaggtcagagaggagatgcctgtcagtttggggcaaggggatttgggaagtttttggaggaaatcaaatgggagacaaaagaatttgtctgagagctggagaagaaggaatagatcctagagacattttcatttttgttgcattttatttttatagatttaagatgtgtaagtacaaatttctcatgtgcatatattgcgtagtgatgaggtctaagcatttagtgtacccatcactggaatagtaaacattgtacccaaaaggtaatttttcaaccctcacctccctcccacccttccatcttttgcgatctccagtgtctattattccaccctgtatgtcatgtgtacccattgtttagctcccagttataactagagatatgttggaagtaaaatgcaacgggcttgatgaccttgcaggaagtcagcgaggagtgatcagcgctgatagaggcttatatctttggagtttgtgtgaccatgctaacttttaaacaggaggaatgatacaaaataagatgcaggtttggggttcttttccaaggtcttgcctttacctattggatgtcaactatcttcttgggtcattgaacaggagctcttcctcttggcttgtggcacagatgagtttgcttctgtcatgacgctggggacatggggtcctgtgtgctaggccaggcattgggccgatgtatgcctggggctaccgcatctgctgctgctggaactgggtctgccctgtgtccctcgggattccagcaagtggacttcatcgcattatcatgcattcacctggtcagtttctgcacgggctgtttatagggcacgggtttaatagctgtctcccctgctgcactgcagattccacgagggcagagaccatgtccggctggtcgatcatcctctcctaggaaaaggctctgcaaagttttcctgtaaagggccacacaggaaatatttcaggccttttgggctgtgccatctctgttgctattcaactgcctttgtagcgtgaaagctgccttgatgatatgtaaacagatgggtgtggctgtgttccaataatactttatttatggatgcagaaatttgaatttcccatcattttcatgtgttgaagaatagtattcttgtgatcctttttccccaaccatttaaaattgcaagagccattttagcctgtgagccatacaaagacaggcagtgggcctgcggtctgaaagcatagtttgttggtcccgtcctaaagtttagcacagggcctgtaatggcagtaaacactcatttcatattgtggaagaaaagaaagaaggtgtgtaagttgtgtttttgtgcttgctttctcctgcagagtgggtaaaggaatggtactgaggactagtaaaatgcaaagatttggtatcggtaggtcttcatcctgctcctaatgcatagtgtgacctggagccagtttgtgcagctctttgggcctcagctgtcctatctgtgtgatgaggagaagcctagcttcattaagggatgtgaaaatgcttttaagactgggtgcagtggctcatgcctgtaatcccagaactttgggaggctgaggcgggcagatcatctgaggttaggagttctagagcagcctggtcaacctggtgaaaccccatctttactaaaaatacaaaaatcagccagatgtggtggcaggtgcctgtaatcccagctacttgggaggctgaggcaggagaattccttgaactcaggaggtggaggttgcagtgagccgagatcatgtcgctgcactccagcctgggcaacagagtgagactctgtctcaaaaaagaaaatgcttttactctcaagcccactgaaaagtgttaagttattacccaaagcaggagaagcagcacaatagaccaggaagctctaaatcctgacaagccagtatttacgctgcagccagcccagggctcagctgcagaggcagcgaaatcctaacagtgagcaggaggatttgacatctggtgcccaagaagtttgttaaggttgcccagtcacttgctgacatgtgctagcaaattctcatgctttctccaaaaaaagggtatactatgggcttcgctcccacaacattttggtaaatcttccaagaagatctggctttcttcttgttaaaggaagcatttgatggcagcctggatgaaatagatatcaaatctgagtgacattattgctgttgttaaactaaagctgaacctcttaaacttggcatcagttgactctcctctttgtcagaaaacctatgcaggatgccatgtgatctggaggacacaaaagcatgattgtgtcatttctttctgtatggagtctgtgcagtcagacagttcttttctatcttgctttcttccttgggtcaggacaagtccaattcactgaatgcaccaagccccttctagaaaaacagcacagggctggacacagtggctcatgcctgtaatgccagtattttgggaggctgaggtgggcggatcacaaggtcaggagttcgagactggcctggccaacatggtgaaaccccgtgtctactgaaaatacaaaaattagccgcgtatggtgtgtgcctataatcctacctactcgggaggctgaggcaggagaattgcatgaacccgggagacagaggttgcagtgagccaacatcgcaccactgcactccagcctgggcgacagtgcgagaatttatcttggaaaaaaaaaaagaaaagaaaaacagcacaacaaacaagaagagttcagtggttacaatcaaattttaaaccaattgtcaaagtacaagccaccactaagcagatggtgggatctggtttttgttttgttttttgaagcataatggatcctctgtggtatgggaattttaaggggaaaaaaaagagaacaatttctccttctctgcagtacatttactgctgctatcactctctttctaccctgaaatgtttctgtttcaccaccattcatctctcttgattggttttgcttttttttttttttttttcttctaagatgttgctaaatttgcttgtaaagttttgtttattcattggcgcttggttgaaaggtgctggatcattaatctaagtattcaaggttaaccatgctttatgctgaaattgcctttttatggaacagatttcaaggttttgcaagagttgagtgctacctcatttttgacatttcagcaatgaatcctgtttgaaatgtgatttgaatccaatcatcatcttatttgtggaggaagataaaaataatatacaaatattgcagtaaaattgcatttttccctgccccctgttttgcatttcaattcagctagattctgctagggtggcacccagcaatggcatccctgctttaattctatctttcattttttttccctcccagaaggcttaaacatatttcctttctatctaacataagttgtacagggcttctgaagagtgtgcattgaagaaatggagcttacacaattacttctataccttattatggaatctgagggtaaacagggctttggaggtcatctaattcgtctccttttgcaattacagaattatttctttgaaggaacaaatgaagaatctcttcttccaggcctctttgtaaatgtgtgaacaagtttataagtgcctccatctcagagtgtgtgtggatgtggctttttaattaaagaccaaggcttcaagctttgctgttttctccgatctgatatagccactgttcctagtcacatcatggagctcttggtcagcctgtgatctgggaggtttcttttctaactaacgtgtatccttcccttagaactagtctgcaggggctggtaccaggcagcctctcttaagaaacttacacccagaaactgctccatttctgtgtaaatggtagccatgtccgagtgggtgtcactcaccctatttcagcagcaccccctccctgtttgctatctacaaattatctctcccctcattaaagtttggtcttccaaagcttttcaaactctcagactctcattcactctaaaatatttacagattaaccatgttcagcctcagcatggtgtcatcatgggaagatgctctcagtgtggacaagataaagctgttaaagctggttgagccaagctttttcgtatttaaataatggaaacaggaacaggcagtatgcatagttaaggacgtaggtctgggttcgaactctgcctttgctacgtcccagctgtgcccatgacattatttaacctctcttgcctcagttttccccatctttatttttgttttattttattttattttttgagacagagtctccctcttttgcccaggctggagtgcagtgccgccatcttggctcactgcaatctcctcctcccaggatcaagtgattctcctgcctctgcctccccagtagctgggattacaggcatgcaccaccacacccggataatttttgtatttttagcagagacagggttttaccatgttggccaggctggtctcaaactcctgaccttaagtgatccacctgcctcggcctcccgatgtgctgggattacagcaagtttttcccatctttaaaatggacacaataacaaacctactttctaacactattgggagaacagaacaaggtaatgaacagaaagtgataagcacagtgactcatgcgtcacgtctacacatcgtatttagcaaaaagctaagcaagttattcccttgctgtgaattatcagattctagtaccagggagctgaaatactagtctgggggaagagtgtgccaatgagatctttgtatgggacagcttccccaacattagtgtgggaattccattaagaactcatttcttttttttctttcttttttttttttttgagatggagtcttgctctgtcgcccaggctggagtgcagtggcgcgatctcggctcactgcaagctccgcctcccgggttcacaccattctcctgcctcagcctccccagtaggtgggactacaggcgcccgccaccgcgcccggctaactttttgtatttttagtagagacggggtttcaccgtgtcactcaggatggtctcgatgtcctggcctcgtgatccgcccgtctcggcctcccaaagtgctcggattacaggcgtaagaacacatttctaagcttcacactgctgtcctgttgtcatgatgataggtcaaacttactgcagcttagtttgggcgggacattttggctgggaacaccaatacccgtaaaggtcatgtttacattcttgtgtgagcctttctttaaccactgagtgtattttctatcatgattatcatccacttcttgctgtgtattggcatgagggagtctttgtcctcctccatttgttcatccaaaaattactgaatagctaattaaccccgatgctggggatacaccaaacatgattcctgcaccttttcgagcttatatttggtggaaaggatagaaaaagcagcaacaaccaataaatggaaaaataaataaagccatcacaggtggtaagatgtctgtaaaagaaaccattgcgtcccaaagagagaaaagaagttcttttagtatctccagttgttaaaatagtgtctgacacatagtaggaactcaagtgattattcactgagtaaatgtttacggtaaatggaatagtttaggtaggggaatccacaaagattctctggggatctactatttcagcagaaatataaagaattattcatgagatgatcaaggggccagatagggctgggaggaagggaagtatgggtggtgagaaaggcggagagctggaaagatattggattgtttgaggaattgtggaataaagaatctctatggttgaaaaataaagagagaggtgttggggtagttattgattccgcaaagatgaagctcagagagtacccaggaacatgactggggtcataggttctggagaggaacttggactttaattgaaatgcaaggggaaatgactaaagtcttggtaaagtcaaagtccattggcaaccattcaatgaacttcaaatccatgccttttagggttggtgaccctgaaggatgaagcgttggccttgagaataaggcagttcttgtaagttcaaccactggctttcacttacagccttcatcacatcactcacctcctgtaagcatccgtagccttcattttcaatggagaaaaaagaagttgagatgcatttctccccattgctattttggaatccactcagagcactcagcgcctgctgttgttctcattggaatcttgctgtcccatgcaacttgacttctatttacactcctcggattcgtatgtgcaagtcttgcttgtgagggaagagccaccctagatatgaaaggacttgattaggaaaaaaaaaaaaaaaccttttgaagagagaggtgtaaaaaaaatgaagccattagcgtcaacttaaattcaagatatttgggatgatacatctgcttataggctcataaaacaggcaccagctcaaggttatgtgaaacaaagaaaatgtctagcattgctcagctgttttaggctacctaattatatttttagctttatgcacttgggattctcttttcttttttatttgttttgagggtgtatagtgggcacctgtcaattctgcagcccagaatccatgcccctacttctctaagagtgtccatttttccctctggtgatcattcctccccattctcagaccttttgacttccaggagagcttcgtctgtctcagtctacagggaacaagtgtgtggcttccacctggctctgagaagcactgtgtaccccagtcactatgactgttgaaaggtgagcatgcgcacctatcagaaccagtgacatgaagtttgtggaacattttttttttttttttttttttttggagacagagtcttgcttttggccaggctggagtgcactggaacgatttgagctcactgcaacctctgcctctcgggttcaagcgattcttctgcctcagcctcccgagtagctgggactacaggtgcatgctaattttttgtatttttagtagagatggagtttcaccttgttaaccaggatggtcttgaactcctgaccttgtgatccaccaacctcggcctcccaaagttctgggattacaggtgtgagccaccgtgcttggtcctgtctgtggaatttttaaaatgtgtttgaacttgggggacgtaggtctgaagctgtttgcagccattttggcaccatgtggagcgtaggaatgaaactcacactcacagaaagtgtgaagaagagcagaaagaaagaaatgaagaccaaggttcaatggcaccatttaatggtgatttaaaacatgtgtttgtttttatttttacttattatttattatttttaattaatttgtcttttagttgacaaataaaaattgtgtatatttgtcgtgtgatatatatatatataatggaatactactcagccttaaaaagaaggaaacctggctgggcacagtggttcccaccagtaacctcagcactttggtaggctgaggtgggagaattgcttgaacctaggagtttgaggctgcagggagctatgattgtgtcactgccttctagcttggatgacagagcgagatgctgtttcaaaaacaaaaacaaacaaaaaggaaattccatcacttgtggcaatatggaagaacctggaggacattcggctaaataaactaagccaggcacaaacatacaaatacaccatctcagtaatatgtggaatctaaaaaaagttgaactcacagaagcagagagtagaatggcggtttccaggggctgacaggtggagatggagagttcaggagatgttggacaatgacatcacttgaaaggtccctggatccagctaagccttaacccttttatccctctaactactgagttacctaaactagtaaattccctttttttagtcttttcacccagcttggctttgcacttttgccagctgcaaccagcaaagttcacactgtggcaggggtgctcatcagtacgttcagttcatgaggaggactcagatgatgcatgctgcagggattcagagggagaatttcttttctccttcatagagcccatttttctgtgtctgtgggcacaagttgggaaaggagagaataatgaaacgacatgcacagatgcatacaggactctgcagagatggtgcaggcattgtcaagatgacctgcccaccactagcttacatatccttcatttttttgtgtgtgtttctttcaacactcttcgatcatgaaactacatcttttattttccttgacagtgctcaagaaaatgtggtcattaagtttatcatcatgaaagcaggcacctggtttctgaaatactagacttcttcatgtgtatcatctctgtggtttttcagaactctaaaatgaaggtccacttagtccaattgctgttctaggaacctgtgatcttttaatcttggatgtctctacctaaactatggtgtgagggtggtgtactaacaagcaactgaagttgaatgacaagagtaaacatgaggtaggtttttctcagtgctaatcaatgacgaacctcgtgctcaaaaattcagctcaggctgtagccaccaaataaatcatgggccagagaggttcagggactcaaagacatgaggctgtacccaggagaaatcaagctatggactggtaaggctcagaataaaaattgatgctgtcttcccagtatttgggataataggattgtacctctttgagctacttatgtgtactgccatctgagtcgctgtctcagcatttccagcagaaatgcaacagggctggtgaagtgtccaggagtgaatgacttgtaagccattaggaaggccggggaaactgtgtttgggctaaattgcttttggtcaggagctccatcttctcatggctgtgaaatgacggatacctgagagaagtcccagctgaaagccgtgtctgcactgttgttttctaagtggatgctaatccgttaattagaaggtttgcagttatccttggcactgtatgcgtgcatacattagtatttctatttatgcacatgcaatggatgtatttacatatccgtaaacctgagtctttttacctacctcttagaggtgccattctgattattttctggtttagagatggaaagacaaaatctgcccctccccacccccaaatcctgaacttgagtggagctgtggtgataatactgaactgaagggctgtgcaggtacctagtgttttactttgtgccaattatttgttaatgcaggtatcaattttttaaaaaatgttttggatgacttcagtgtgccgggcactgtgtttgtttctgggaataaaatagagaacaaaaaacagagaaggtgtcagcccttttgcaacttataatttagggagggagtgagaaaaaaaaaagcatggaagaaacatatcagatagttatgatttaaattaaataaaataaactatgaattaaaattagttgatgcgacagtatatggctaggtgagtctctaagcttaggttataaatgatgacttttacaaagagactacccttaagttgaaatctgtattataagtagggagcacctataaatatcggggcagggggttagttttgagcaggtggatcaattagtgcaaaggtcctggggcaggaaggaggctggagtggtttgggaaccaagaaagagccgggccagggttgcattttagtggatgatagggaaggcagcatggaatgaagtggagacgggcttgtggggccgggtttctcaacctcagcactactgacattcgaagctggagaatgctctttggtgagggctgtcctgtgtatagtaagatgttcagcagcctctctggcctctacccactagacgatagtacctcgcactcctccagttgtgacaataaaaatgtctccagacatttgccaaatgtcccctccaaatgtgacaaaatctcccttggttgaaaaaccactgaaattggccttgcctgcaagaagtttgagtttattctaggatccatggaaagccactgaaagtttgaaccaattaagtatcacgatttgggccaggcacggtggctcacgcctgtaatcccagcactttgggaggcccaggcgggccgatcacgaggtcaggagatccagaccatcctggctaacacggtgaaaccccgtctctactaaaaatacaaaaaaattagccaggcatggcggcgggcacctgtagtcccagctactggggaggctgaggcaggagaatgacgtgaacccgggaggtggagcttgcagtgagccgagatcgcaccactgcactccagcctgggcaacagaacaagactccgtctcaaaaaaaaaaaaaaagaaaaaaaagtatcatgatttgattcacatttttaaagatcattctatttgctgtaagcaaatgggttgcaggaaggcaatgtggaaaggaaaaaagttcatggtcccagagagaggttataattgccttgatggaaggtgatagtcatgggaagaaagttctgtaggcagatatgatttggataaagttgacagaatttatttgtggaccagatggatgggcagggagagaaggagaagattaagtacaattcttagatttttaaataacaaataggatacccctcccatcctcgaagagctcacactgaagtaagggaaaacaaacatatatattgcactcattacagtgtgctctaataaatgcatgaacaaaatgtttcggcagcgctgaggagagagtgaataagtctttcagagaaagtcagggaagattgctcagaggctgtaaaagcttttgaagaataagtaggatttttctaagtggagaaggagctcaggttcctggtctatactaagaggaaaccgtaggagataatccctcttcaataattcaaactgctgtcaaggaaaattatgcccagagtgactctgttctatggcctgggagggaaactggggtgaatgtcctaaattgttgtctttgaaaagaccgtttctaaaattcgtggcccaacgtagccttttactggttaactctaagtatttaagatgttctccaagcgttttaactgaagacactgcgtcttattttgtcttcattgaatttcgaagaagcatctgtagtaagaatatttacacggtttttctaggtaattgtttgtctcctggaccatagagtaccttaaatacgttacattatataatttactaatagtaatacaattttatgaagatatctagaggtaacaaattcaagattatgtatttctatctctggaataataattactgttttcatttgtaaaagagattgtaagggaaataaaatgtaaagttaaagctaaatgtcattgtattctatgcttgctgtaaggtcaaaatatgtgatcctgatggaatatggtaatatccctttgctctcctccgcacactgaggaaccttttcctgggactaatagacccccctaatgggatgcagacagtgcctcagagtagatgttgttccataaatatctgggggcactccagattgggaccttgagaactagatggtatgctaaattccctccttcctttgcaggaattaaaaagcatccctcaaattgacaagaaaattggataataaattaaccatttacagtttggtaaatatatgcacaactgaagttccacgtcatgggccatatttttatcagacgcaacaccagatgaaggataaaccatatgacccaccctcttctgccatgaatgaacaatggactgaagtctttcataattgcttgtttcaagatgctcactaaatcagacaaggaactcctgtcttgtgtctttaagggaggttgaacaataggctgggacactggagtaaatggggcactctgccatacttacactttcctttgaaatttgtgtttgggaggctttaactatgagtatattttgcagccaaatgcagttagctttttgactaatggagctggtgtgaattttacccctccatctgtagatgctgaaatgtcacattatttcatttttctaaaacaaattaaatgactctgagcatccagtcattagggttttaagaaactcaatcacaactatgagtatagggaatggggatgaacagtatccctttcccatatgctagatagacagtcacctgtggagcttagcagtgcttcggatacagggaaggacagctggtctttgagatattgtgggcatttgggtgttaggattcttattacttaaacctgcccagtccctataaaaagggaccgctttgcaaattctgatccatgcatggaacaggaaatctttcttaatatttagctgcttcatgcattcaaatccttgaagaccccccacatgccctgcacccttctcagttccctttcaatcttggggtatctcccctttctgagaattcactgctgttgctgacctcctcccactcatttccttccatcttctcttactttcttaataccccacattatctctgctgactgtgtctttagacacacaacacttttctttaaggaaaggcaaggctgtgtgttccttacctcatcatgttatgttagaggtccaaatgttttatgggtgaccaattaattcatcatgtcatctggatgactgttgaaagcaaaagcgggatcattgtaagaactgtgtcaggaaaccagcaaaaccagccctgtcccaggcaaactgggaattatgatctctctctggaaggaaagaagaagaaaagtgggagaggtaggctgttctttttccaacaagaatcttggaaggcgttttcattttggaaactgtttagaagactatactaaattgttactccttattaccaacatgcatagcatcctgcaatgcagacatccatgactgtgcatctccactgcttcaaacagggcactagtgttccaagctttgtgtttctattgccagccctgaatgcaaaaatatgggatcctgagttcaaatcgggctcagaagttgacatattgtttgaccttgagcaatctgcttaatttcatagtgtttgtttgctcatctgaaaacaaaagggataatgctgatcgaggcatattgtggagattaattagtttctgaagtgctgagatccacagatgaaaggctttaagtggaaattattttgtttttaaaggaataatcgatgcatgtgaataaaagagaactaactgaactgaattacaggcacttggctgctggtgggagtgggggaagaaagaatattgcttcttgcaaagaaccttaaatttaccccccagaatagcagtgggaaaattgctttttttttgtgattctgaaaggatgagaaattatgcaaaagaaacgagctagaataagaggagaatatatgcagttaagacatatttcaaagtaactttcctggataaacaactaggtatctaatatatatattatgtgtattagatatatatatgatatatatgatatattaatgtattagataatgtgtgtgtgtgtaagtatgtatatactccaccagtcctctgtgattaggttcttagccaaatgcttgtctaccaaaacagctcagccacgatccccaaggagccttaatgacccctaagtccttggtgaaaagatcagtttgggaaggagaaactaactgtttaaaaatctcacagctgtgtatcgtggtgagaaaactagcactattaagcgtgttactgtttaaaaccacttttgctcttgttacatttggtcttctctccaataaatattattattgcccttgatgtacagataggaaaatgataatcagggaaattaaatggctggccaatggccatttgtttggttaggtggtataggcaatattctgacctcaacattatgactcacaagactctgaccatgtcactgtcaccgaagggtttgctaaagatatggtgacattcagctggcatgtggaaatgaattattgtctaaggactacagaagaattggaatgaagacaggattttttttgtcaaagaaaataaaaagttctgaccattaaacgaatgcgtttttgtcatagacgtggtggaaaatgccaacaaagtcagatttcaaaattggctcaaagtctcctgagtcaaatgaaaactctgtcaaagccatgttatacttcttcttagtcttttatccatgcattttaataatatagttatggtcatgttatcccaaattcttttcaaatgttgttttaatggctctgtaactttctaccttgtgactattgcatggttgttttgacctttttctcattttttgtagatatttaagttcttactttttttttacttttataattagctctgtaatgagctttttgtgtgaaaaaacatataattatatacagagttattaccttactacagattcataacatttggattattgcatcttgggaaataaatattgtagtgttccttgtgtatatatcaagtttatatcaataccatctatatacttatatatcagattttataaattaaatgtgcaatttattgtgtaccaaatatatttcaataaagctgttttttaacatgagggccttgcacagtagctcacgcttgtaatcccagcagttttgggaggctgaggcaggtggattgcctgagctcaggagttcatgagcagcctgggcaacacagtgaaaccccgtctctgctaaaatacaaaaaattagctggtcatggtggcgtgcacctgtagtcccagctacttgggaggctgaggcagtagaattacttgaatccgggaggtggaagttgcagtgagctgagatcgcaccaatgcactgcagcctgggtgacagagcaagactccttctcaaaaaaaaaaaaaaaaaaaaaaggacaactaacacctttactcttatggcagtaacagagtagcttgttttggagtaatcctatcatagatagcaattataaattctagataggatagtaaaaatcaccttctgtttgatggtactccccaacaaccataagtaggcagaaattgaaggggctttgaccctggaaagagaggtactgtaacttgataaaatgagatgcatttgatattcacccccaaagtacacaccaatccatgtggtgcaaggaagacgagactcaggaaggctacagtcttactgagtttgagaaataaaagacagatgtccagaatagttagaaagtatcaatgaaagacacatagatagactaggaaggaagatgcagatttacctataaaatctacacacattctggtggatctctgaagcatatttatataaaagaggctctaggggagcccgtgggaagccatagctggacgactgaaagaaccgagtggatactcgagttgctaaacaggtagaggatgcagaatgggagtgtgaatccagcaagttaactgcctgctataacaaaaatcagcactcttctgagtaagttaacaaaattcagcctcattaatatattatccatgatgtccttttaaataaaacttactagatgtgtgaagaaacagagaaacattactcatagtcatgagaagaagcagttaaccctgacataaaaaaaatgttggaattaacagataaggactttgaaacagctggtataaatgtgaatagtaattaaagaaataactagttatataaaaatgaaaattttagaattacaaataaaatatttgaaatgacagttttactatatgggctaaacaggagaatggggacagcacaacagatcagtgaatttaatatagattaatgtatatcattcaatttgaaaaaaagcaaatgatttgattattaacagaagactagtgatttatgggataatatcaaatgtatacagctataggtacttggagtcccagaaagaggaaggagaagataatgcataagtaatagttgaaatttcttcaaatttggtgaaatactttcaagaagctcaagaaacttcaagcaagcaaaatataaagacaagcacacctagtatgattttaatttccacgtcatagtcacagtgatgaaaataaaagataaaaacatcttgaaaacaatcagagtgaaaaagaggcatttcctacatggggcatagtgatatccgtgatggtcagcttctcatcagaaacagtggaagcaagaagacaatataatgacgtcttttaatggttgacaaagaaatctgcccacccagaattctgttttcataaaaaaaaaatccttcacagaaattaataggaagatgcattcagacaaatgaaaatagatgttttattaccattagtcctgtactataagaactgtagctttaaagggtatcttcagagtgaaaggaaatgatgctaggtgagacttaaagagatgaatgaagagcagggaacatggtaaatatgtggataatataaaaggttataatgcttctttgaaaatatatgtaactgtgtaaagaaagatgacatcactgttttttggagtttgtaacatatgcagacacaaatgatgagaatgtgaagcaaaactatactgttgaaaattttttacacttgccatgaagtagcactgtattaatgctgagtagactgtgctgtgttaagattacatagttaattctgagagcaactactaaaaatattacaaaagtgtatagtgagaaagatacggaaggaactaaaatgaaataatagatatatcacttaacccaaaatgagactgaaaaaggggaatagagaaacaacggcataacaaaaacaatagtaacaaaaagcaaacagaaattaaagagcaaaccataaacataagtccaactatgtcaggaaacttacaattatggcagaagggtaagcaaacacgtccttcttcacgtggtagcaggaaagagaagtgctgaagaaaggagcaaagccccttagaaaaccatcagatctcatgagaactcaccatcatgagaacagcatcagggtcaccgcccccatggttcaattacttcccaccgggtttctcccataacatatgcggattatgggaactacaactcgagatttcggtatagccaaagcatatcattctgctcctggtcctttccaaatctcatgtcctcacatttaaaaacacaattattccttttcaacagtcccccaaagtcttaacttcttccaccattaacccaaaagtccaagtcaaaagtctcatctgagacaaagtaactctgttctgcctatgagcctgtaaaatcaaaagcaagttaggtacctactagatacaatggggtacaggcatcggataaatacactcattccaaatgagggaaatttgccaaaacaaagggactacaggtcccatgtgagtccaaaatccattagggcagtctttaaacattaaagttcccaaatgagctcctttgactccatgtctcacttcctggtcatggtgatgcaagaagtgggcccccatggccttgggcagctctgcccctatgcctttgtggggcacagccacctttccacctgctttcatgggctggcattgagtgtctgcagcttttccaggtgcacagtccaggctgtcgctagatctaccatgctaccattctgggatctggaggatagtggtcctcttctcatagcttcactaggcggtgctccagtgggactctgtctgggggctccagccccacatttcccttctgcactgtcctagcagaggttctccatgaggattctgccccagtagcagacttttgcccggatatctgggcatttccacacatcctctgaaatctaggcgaaggttcccaaacctcaatgcttgtcttctgtgcacccacaggagcaataccacgtgaaagctgccaaggcttggggcttgcaccctctgaagcaatggcctgagctgtaccttggcctcttttaaccatggctggagctgaagcagctgggatgcaggggaccatgtcccgaggcagcacagagcagggtggccctgggcctggcccatgaaaccacttttccctcctaggcctctggtcctgtgatgggaggggctgccatgaaggtgtctaacatgccctggaaacattttccccattgtcttggtaattgacattcagctccttgttacttatgcggatttcttccaccagatatgcgaaatcatgtctctcaaggtcaaagttccactgatctctagggcaggagcaaaatgccaccagactctctgctaaaacacagcaagagtgagctttgctccagttcccaagaagttcctcatctccatctgagaccacctcagccaggacttcattgtccatttcaccatcagcattcaacaagtctctaggaagttccaaactttgccacatctttctgtcttcttgtgagccctccaaactgttccaacctctgcctgttacccagttccaaagtcacttccacatttttgggtatctttacagcagtgcactccactacctcaataacagcttatgtattagttcattctcaagctgctatgaagaaatacctgagactcggtgatttataaagaaaagaggtttaattgaatcacagttccacatggctaaggaggcctcaggaaagttacagtcatcatggaagacacctcttcacagggcagcaggagagagaatgagtgcccaatgaagggagaagccctttgtaaaacccccagatctcgtgagaactcacccactatcacgagtacagcatgagggtagccagccccacaattcaatgacctcctgtcaggtccctcccacaacatgtgaggattatgagaactgcaattcaagatgaaatttgggtggggacacagccaaatcatatcaggtgatttgaacaacactatctaccaacttgacctatgacatttatagaataatgtatccaacaactacagcatgcacatgttttcaagtgctcatgaaatatcccctcaaagtagactacatgttgggtatgaaatcttaatgcatttaaatttttgaaatattgttaactatgttttctggcaacaatggaataaaattaggagtcagtaattataacgtacctataaaagtaccaaaattttggaaattaaatagaatacttctaaatgactctcacattaatgcagatatcacaagagaaattagaaagtattttggactgaatgatgatatctcaaggcttatgggatccggctaaaaaacagagtgaatgtatagctatagatgctgtaaatttactggttgaaatgttagagagatttaaagtgaataatccaagtttctcctttaaaactagaaaaaaagaaaattatacccaatatagtaaaaggatgggaatagtaaatataaaaacagaaatcaggctgggccttgtagctcatgcctgtaatcccagcactgtgggaggctgaggcgggcaagttacttgaaatcaagagtgatttcaagtgaaatcacttcaaatctggccaacacggtgaaaccctgtctctacaaaaaattcagaagttaaccaggcttggtgggcgcttgtagtcccagctactcaggaggctgaggtgggagaatcacgtgaacccaggaggcagaggttgcagtgagctgagattgtgccactgcattccagtgaaagagcaagactctgtctcaaacatacacacaaaatcagcattgatagtacctgatggtgttggattgaaattggagctatcagtatcaatttagtttttttaaagtatatacataattatagaaatacacaaaacttggaaactccaggagtaatcagcacaactagctcccagatcttggtttctaaatatcattaatcattaaaaggaaccaaaacttattggagaaagggtgattccagaactggggcaaggaaagaacaatatgaacctggaacaactctttctttttgccagaaagtcaggaatatcaaagaatgatgggagcatgtccaaaggacacaggcctcagcttcaagtaccatccactggccagatctgggataatctgagtatcaaaatgtaaataatagcaagagattggagctcactgaatgaaaggcaaatgcataagtgtacactgatataaataaattagaaaatgaaaaattcttcctcacaatataaacactactactaacttataagcataactcacacctgtgaaaatgagttagggtaacttcacttatgataacctcaccaacattggactgtgatcattttaaaacctacgctaatttgaagggcatgaaatgatcttttatttggatttataggactttggatcattaggggacagcagtgtttagccgtatgcttataatgtgtctttaactaaaatatgatcatttttcagtcattttgtagctttcatttacccataccccatttcaaatcccttgtataatggaagccactattgctgttcccagagtgactccattgttcttagacgcagagaacgaaggaagaaatcaaagtttaaagataagtttactgttcatggaaaacattaaatgataaactatagtttatttaaaatagaaaatgattatttcttgggcagctattgcatttatgggatccattttatatgtatctagtaaatccatcaataaccctgtgatggagtaattagagaagagaaattgctattgtttccactttaatgatgagagaagaaaatacccagggagattaagatcgtaactgatcatcatggctgagccagaccagctaactgtcgaaacgttcctctggccccaaccgtgatacctttgtctaatggtggggccagggagaagggtcagaaggatgagatgactggggagaagaaaacagaaaaaaaaaaaaaagcattttcttgtgagtcctgtcccaaaaaaatgctaagcatgcatgcagacacccattcattttatacattttgcttgagtccctgcagtgtaccaagagctaaactaggcatataggaatgaccctgacattcatccccacccactggtctctggggtagaataaacttcggaagcttcctatgtagaggcgaccatagtagagaactgaaatctcaccctttgttataggaggataagagaaaataaacgtggatatttaggtgtgttcttttccaaacaaaataaaaatgaacaaacacatttgcttgcttttttttcctttggatcttttatcttttaatgcactttcattggaattcaatccatacatactgaagggtggttgaagtaataaatacagtctttttctccaaatggtacccaaatgaaagcaaagtactgctttctgcttaagagtgttcagtttgtccttgacctatacatttacactgggttgctgtcctctgcctccttccactactgtccacacaatacctatgtaaacacatacacacacacaggccttaatgatgagtaaggcccatttatttagaaaacatggtttgaaggatatgttaaaatcatttgtagataaattgatatttttatattattacttctttcttgggtttctgcctttgatttagactgtagccagttgtgcctgctatcagttctggaacctaaaattcatgtgggaagaatttaagtgtaaccgagatgtaattgtgattgaagcagggaatgaaatataaacactaatcaaagcttcagtagacatgttttttttgtggattaatacatcacattttaaaaccttcaacccttggcttctcagttttttctgtttattgttttgtttgttgatgtatttgtttaattcatgggttagaggcttgggtgctgagagagtcgattgtgttaaaacctttagtgtggaggtcatgaagaggactgagaatgtttgatctttcactgtgggtgctgaaccagcagcatgagtatcacctgggagattgttagaactacagacttgcaggcctgtattcaaaatctgcattttaaaccaagatactcaggtaatttgtaaacaaaagtttgagaagcactaggtcagtttactccagctgtctaaaccagacctgccactcaggtgttaagaacccaagcaataaggggtggcttgcttttgataatctccctctaatcttatcagagactttttttttaaatagaggattctactcccatcatccaggcaggagtgcagtggtgtgaccaccactcattgcagcctggaccaccggagctcaggtgggcctccctcctgaacctccccagtagctgggactacaggcgagtgccactacagttgcctaattttttaattatctgtagagatgtggtctcactatgctgatctcaaactcctgggctcatgggatcctcctgtcttgacctcccaaaatgctggggttgtagccatgagccaccgtgcctgacatcagagacacttctgatgagcccaatatatttctaattattggaccctcaagtgcatctggagaggacaccgaaggactgtggaggcatcgagccctatgttcatgcattgactcaagtgtgtccctccaaaatccatgtatggaaaccctacccctgagaattactatatttgaagattgggcttttagaagataattaaggtccaatgagattataagggtggggtcctgattcaataggactggtggcattataagaagaggaagagacacagtaggaaggtggctgtctgtaagccaggaaaagagctctcaccagaatccaaccatgctggcactccaatatcaaacttccagcctccagaaatctgagagtgtaaatttatgttgtttaactcacctagcctatacagctggctctccatgtccatggactcggcatccatggagtcaaccaaccacagatcgaaaaaatatatattttaaattgcatctatactgaacatgagcagattttttcttgtctttattcactaaacaatacagtataaaaatttatttgcatagcatttgcatttgtattaagttttacaagtaatgtagagatgatttaaagtatatgggaggatgtctgaaagttgtatgcaaattccatgccatttgctgtcagggacttgagcatctgtggattttggtatctgtggagggtcttagaaccaatttctgtggctactgagggaccactgtagtatttgtgatggtagtccaggtactcaaggagagttcagttacaaatgcaattttcccctaaagtaacttggttccaaaagagtacgcatttgtagttgtatactacaaatggagtgcgtgtgtgttctctactctaatatttcatgccagagtgagttattagtttttgatcctttttcttctttttccttcatgagcagcagtcctagtttgcttgggacggggaggttttcatggacgcatcatcccttcagtgctagaacagggagagtaccaggcaaacttgggtggttggtcaccttttgctgttcccagattctttcctgagctgaagatctcagctcccttatgagaacttcacattgcttcaaagaagagcagatctcatcagaatccagcaatgacatgaagcattttggtgcagagtaactaccagattagagctcctggaatacttaaaccttcgtggatccccgatatggaaggaagaagcctggctatcctagcttgaatggaattcagcattggtagacggaaccacaaatgccttctatttcttcccaaatatccttttagaacttcgaactaattctagatagagtcttaaggtcaggtataaatgaactgctaagtatttatgcctgcataacacaatgatcaagaggcttcctgtgagcccaacattctcatgctttaatagaaaacttattgtaaaatttgcactctactctataacatagaaatgtctatcatttctataaatactatgcagtctcttctgatatatctgttatcctatcatacaagagcagatggctgggattttatcacagttagagggtgttttgagatgggctgcaaatcctctggagaatttgatttggagactcaattagtcatgacaagttaggttatgctgcagtaacaagttggctcctgaatctcaatagcttcataaaacaaagctttcatatgtccagtgttgggcattgggaagtgcaccaaatagtgcctcagggactcaggctatggaggcttcaccatcccaccaccgtatcatctggacacacaacttcctttgtcagcatgatgggaaagaaaacatggagaattgtacaccagctgatccatgcttaggcctgcaagtgaaactccttggtcagaactagtgaaatggccccacctaacaaggtggaatgagaatgctgctcttctgtagccataaagggaaggaatagcaaaaatgaaagtgaataggcataatatctaacacaagggtccaagaggtagaccctatacatgacaaactgtaattccacagaacagctggagtcattgatttgggaactagccactttacacatgggctatttttacatttgtttcaaggagtagtggcagggatgtattatttaataatgatcaataaaactcataaaatattgagggagaaaacaacttctattacaaaatgcaatggtttaacctcctttccacagaataaaattgcaagtgcatgagaattatcacatatgtccaaggatacacatattcctaccttggatgctcacatactgtgtgcaggaaggtgagaacgcagaggaattaaggactcagaacttgtctcctctcattaacagccaatgtctcacatatgtcctggtggatcttacagggctcagcctgaatgcttctctaaacttttccacatgtagtaaggctaaagaccatgtgttttacaagatggcaacactcaatcctatgcttttcactgaaacagaatgctctgtcattgaagcatttctctggggacctcagattctctttacagaggcaatacccattaattctaatgcagcctcctgtcatctgggactcatgaacttccaccgcagtggtcccttcctataatcaaactgtagtagcttctgtctccatagaagatgttagacatgcccagaaacctggtatgcaatgtcacactctgccaaaagaacataaaacttagacaaatatggaagtcattaacactgaagagttctttgctattaaaaataggaaaattttattactttcctacatgagaagaatatataatacctttagggttatttggtcatttggaggctagcttcttttctctgtttgtagacctatttttggaagtcgaacattttttttttttttcattttaagcaccctattgatacttggcatctctgcagtaatagaattttgaagagttcatcctgttcctatgctcggtcaatttttggataagtctgaaaatgatgctgtggatagaggatgctgggacccccatcatggcaagcatgcatcattgcaaagggtcttcataaggttatgtggaggctacctggggtcaggatccattcagagctggaaaacttaaatagaccaactgatgttagaaatagaatagatccatggcttgaaatgaacagttgtgtgtttatatgctggctgacccccctactgactgtgtgactacggaaaaaacaaaactctgctgcccatcggtaaaatgggattatgatccttgcctaacttcctgtttatagggttctggaggtcccaatgagataaactcttttgaaagaggtttggaaaatgatgcattatttcacaacaacatggtgttacggttgaatatcaatgatagagagtaattgagatggctatgtaacatagtggccagtcatccatttgcctagcaaccatctatattatttgtatctgtatctatctatatgtctatatgtctatacatctataactatatttatatacctacatccttatctgtatctgtacctttatctatatatatgctatggatttgcctatgtccaagtctatatccatatcaaatatgtacatatacattttctatatatgtaatccatttctatctctatatgtctatgtatatatctatatctatatctttacctatacctatatgtatatatttgtctttgtgtgtatctatgcttatatactatctctatatttatttttatgtatatctatgtctgtatttatacacacacacatatatatagagagaggcagagacagagagaaagagaggagaaagagggaaggagaggggtgtgtgtgtgtgtgtgtgtgtgtgtgacagagagagagagagagagagagagaagtacattctatcctaggaaatgggaacagagccataatcaaggcagcatggttttgacttatagttcccaggagagactttcattaaacaaaaatatcttgaatgaattgcaattgtggtaagtgctatgaaggaaaagtacccaatcacagtataaatcttatcccagcagggaccatcagggaacacaaaagaaataaaacactaaatcaccaatcctcacgcagcatacatggaccgtaggtgtggaccccagcctttgtgagtagatccccactatgttctgaatgttcgcttttccccagaattcatatgttgaagcctgattctcagcacaatagtattaagagctggaggctttaggaggtgattaggccatgagggtagacctctcagtaatggggtttgtgcttttatcaaagaggccagaggaagcttgtttacccctcccatcatttgaggacacacagaaggcaccatctataagaaatgggccttcactggacgtcaaatctgtcgacaccttgatcttggacttccctgcctccagaactgtgagacatgcatttctgttgttaataagccactgtgtctaaggtattttgttatcacagctcaggcagacaaagacattccctaaaagaaaagcactttattctataaagtgctgttgtttgagcttaataaaaagttaaaaaggccctttacagaggtctgtcttaaggaataaggtgtgtgtgcaggggggactttaattaccagtgggatgtatttaatgtatgatttcatttagaatccgggagccaatggttagtgttttttaatagactgaaattttcatcagggcgagttctggatctttatgcagctggtgctcagctcatctttgacctgcctgggtccttttctcacccattccatggtgggaagcagacactttgacttttcagagcgttattgatggaacaaatgtagtttgaatgagcttattagagtgtctatgaagtgtcctctgttcttaggcaacaaggccagtttctctcctcttccctccctctctgacaccgtagtgttatgttgtctgtaacatgttttgttacggttttagcaagttttcaaggcaaagggcatggcattaggaaaattgaattcacaggtcaaacaacaagtcaggtgacctcaggaaaatgacagtgatttgtgtttgcattttaatttaattcagtcctaaaaatgacccatcttgctgctattttctgtgatcacaacttttatgttttcttgtagctagctcttcatgtaattaatcattgcatgaatttctattttatcattttcttttggtgtcgttttaccaccccttctgtgatctccctgaaggtagaaaacttttctgttttgttcatcaatgcatacttaaagcctaacacatatttgacattttataaatatctgtgacttgaataaatgaataaattcacagtctctccctacatactacttcaaatactaatgttttataacaaataaaagtttactgtctggacgtggtggctcactgtaatcccagcattgtgggaggccaaggcaggtggatcacctgaggtcaggagtttgagaccagtctggccaatatagtgaaaccccatctctactaaaaatacaaaaattagctgggcatggtggtgcgcaccggtaatcccagttactcagggggctgaggcaggagaatcgcttgaacctgggaggcggatgttgcagtgagccgagatcatgccattgccctccagccagggcaacgggagcgaaacccggtctcaaaacaaaacaaaacaaataaaactttaccaaacactttgaaactggaaaaccttaaagttgttttccatttgaaagttaagatgcctttgagtgttaattacatgagtctgttcaattgtatgttttttgataatatacctccatgaaaagttgtgggatttttttaagctaagacacatgatttaaaataccctgtgaaacttttaaaaaggaaagaacctgaatgaacaaaataatatggtccccaaatggctgttgtagtggaggggaaaaaggtttcggctaaaatttatccagctgcaaaccactgtcttaagccagcaagaaatttatattcttccgaagctgagggaaaatcaaaatccacaagtgactcttctcttcccctagctgcttcatacactgctcagtttccggagatctgagataatcattttgtccttgagagtctcgtggctgtgctcttggagggtttgggtttaaaatcttaggatttgatcctgttcagaaaaacaaggcaggagcacccgagaagcatctaaaatcagccactgccagaggctgcttgctttacctgtcttgcctgttcaatttgtcctctacgaggcaaaggtgagactaggagccctgcttctgggaaaatgcctctgttaaagaaccatctcacattcctggagtttgttttgggatcacaaaattggcaactttcttttcttcttcattgcagtttagagttttaagcatcataaggctgtgtgtgtgtgtgtgtgtgtgtgtgtgtgtgtgtgctggtgcatatgaatgtgcttttacaggtacaagaaaataaataatccaaaggtagccttctccttggggtgtcctgctgaaacgatgacctagggttcttttttttttttttttttttttgagacagagtcttgctctgttgcccaggctggagggagggcagtggcgcgaacttgactcactgcaagctccaccttctgggttcaggccattctcctgcctcagcctcccgagtagctgggactacaggcgcctgccacaatgcacggctaattttttgtatttttagtagagacggggtttcaccgtgttagccaggatggtctggatctcctgacctcatgatccacccgcctctgcctcccaaagtgctgggattacaggtgtgagccaccgcgcaccttctatttgaggccctgcgctaggaggactgcattaagaccaaggcgtgcggaagcacactgatgttgctgcctctggtgggtgcacgttgaatcacgtgtgtctatccaagaggaatttgtattaacttctagtgcatttggccagaaaatgccatgagaatcagtggaacatgctgtgtaggctgttggagtggaaacaaacctacctggaagtaggcactgtggtctgcaccattcggcataagtcacttagcccctctgagcttcaggtttctcagcgcacagttggggataaaaaggaacatattactcagcatttgtgggctggctaaggacacagcaggcattacctgaacatccccacaataaccccgggatgtagttatcacttcccttatcgttctcatttagacagaagaggaaaccatggctcccgctgctcacaggagaagctagtattattcccctactctgaaaaccaactggatgtcccgcaatcatgggaatacaggtgcaacccatcacatatggccaattgtttttaaattttttttgtagaggtggagtcttgcaaagtggtccaagttggtcttgaacccctggggcaagcagttctcctgctgggacctcccaaagcattggcattactggtgcaagccaccacacttggaccctttttatctagataaccataggtccggagatgactgtgacaaaagagccatgtgctgtacatagcttgatcaaaatggcaaaaatgtatatgtttatgactgctgttttgtgtattcccgatgaacacatgcctttgttgttgattcttcatctatcttccaatacaattttaggtctggtgataatttctggatttctctatttatagaaaactttgaacttcataaatattaaaatgtcctattagctacatgcagactgctttttctatggccatggacattatgcaattattacccgagctattaattaaatttgaaaatagataaataatggatagggatgctatttatgagttaaaagtgagaaaatgaaaattattctccattctgttaccttggatgagtctaacctactgcatgctctcagcttttattattgaaagtcattatgttactttgcataaaatgaacaattggttgtaacaagtcagccctgtacagtgaccagttttcagatgaagtgattaaaatattttctcaataaaacaatcaaaacatggcccttggccaggtgtggtggctcacgcctgtaatcccagcactttgggcggctgaggtggtcggcttacgaggtcaggagtttgagacaagcctggccaacacagtgaaaccctgtctctactaaaaatacaaaaattagctgggtgtagtggcaggcgcctgtaatcccagccactcaggaggctgaggcaggaaaattgcttgaaacccgggaggcagaggttgcagtgagccaagatcgtgccattgcactccagtacaggcaatagtgcaagactccatgtaaaaaaaaaaaaacaaaaaaacaaaaaaacaaaaaaaaacatggccctttcacagtagtcaaatactgggtaatttccatattatacgagttagaaacatgaatctcaccagagaaaaggtatgtccccaagaacagagtgaacatgtattttgggagttactgcagaaagctttcatgaactctttctgataatataatgcgctggtagatttcctctggtcaacttggatttcagtcttccgtttctaccttttaaaggaggccttattagtctctctggttgatagaggatgcctgtttgttcaattcacactattcatggacccctatatgcctttcaatgatcatcctataaaagttatctttccactgcgtttactagatttgagttatcaaatggaaactctcaccaatgtctttgaaacctttttgttttcaccatgcctcataataagaaatacattttacattgaggcagcatgcacctgcaataataagcaagcgcttcacatgcactttgatgtgctccattttatttctttttagaagaaaatgttggtcacaaatgacactcccagttttgtggctgctaatggacatgtgaagcacttacttagttgtctcggaaccatctaatgatctgattcagtgagcaagagtgtggaattgtgagcccgacatgcttacacatcagtctttctgctgttccagagttactggagcgtgcacctggcatttgttgagtctctctttggatggtttgtgtggcactatcagaaacggaactttcaaaaactgataattttggaagataaataattatggaatactcttgcctcagatactttaatattattgagaaaaattacaacaccaggctcagctatttttaaaaaaaatttttggccaggtacagtgcctcatgcctataatcccagcactttgggaggccaaggcgggtggatcacctgaggtcgggagtttgagaccagcctaaccaacatggagaaaccctgtctctactaaaaatacaaaattagctgggtgtggtggcacatgcctgtaatcccagagacttgggcggctgaggcatgaagatcacttgaacccggaaggcagaggttgtggtgagctgagatggtgccattgcactccagcctgcgcaacaagagagaaactacatctcaaaaaaaaaaaaaaaaaaaaattgtagagatagggggtcttgctctgttgccttagctggtcttgaacccctgggctcaagcagtcctctcatcttggcttcccaaagtgctggggttacaggtgtgagccactgtgtccagccaaaatttatttttaatagataatggttaggacagtgaaatttttagtcggctatcattgcaaatgactgtttgccatatgaaacctgtgcttttgaaatgagggtttttattctcataatcggtcaaaacaattgacagagaaagaaagaaagaaaaaagtgtttgtgaaaagattctaaataaagagtgcattgaatgagagccattttgttggaagaaatccaggatcttttgatgtgactactggaagaacaagaccacatgaaggtttatcttttgatacttaattaactaagaatcaggtatttctcagtctctcatctacagctctcctctacacactcacactagcccctgcatgttcttttttgttggggggaactatggcgacaactaaaggctgaaagagttcaggagacaaagaggaactcttagcgaggttgatggggacctgcattttaaagggtgaatgcatgttctccagctggccatatcttaaaggctgagcacatattctataggtgcacatagacgagaaggaaattccaaccatagggatcgttccgcgcaaacacagcaagtgcaagacctcagagagtgccaagaacacccaagtactgtggaaaggggctggaggaagatgcctcccaagagagccagcacaggcccttggacaatgaaaaactcttggaggctttttaagcaggggaagatgatctgatttccattttgtgaagaaccttggaaaggtggatgaaagcagtgtttctaatatctgcctgaattgataagtcaagtcacctaatgtacttgtgtatgtagacatatgtacttatatatgtatatgcaatttcccagtcctcttctctgggattatgtgtatggaatttgtcacatccatttgcgcatgtatttcccgggcacctactgtgttgtctactctgccccaggtgtgggaattaggcagtggccatggccagtaattctgatcctcatccatcttatgtgctgttgggagagaggcagatattaataagcaaacatctaaataaacaagatagtttccggcagtgacaagtgcaaagaagaaaataaagtactgtgtaagttcgttaagcaaaggggtctcattcgattcaagcttatatcccacccaaatatctagcaccatgtctggaaaataatgatagctgtgcccatggattgtagactgtgtgccagtcattgtcaccggccctgtacatataatacagtctctcttcaaaaccactctacaaagcagggattcttacccagggtcaattttacttttagtggacatttggcaatgtctgtcttgagacaattttcattggcacaactggaagaggttagggagtgctgctgacatctagtggatataggtcaaggatatagtcagacatcctgcaaggcatggggtaggatgcagagcaaagaatgaaccggtcccaatatcaatactgttgagtcttactggccaggcacggtggctcacacttgtaatcccagcactttggaaggccaagacaggcggatcacctgaggtcaggagttcgagaccagcctggccaacatgatgaaaccccgtctctactaaaaatacaaaaattagctgggcgtggtggcatgtgtctgtaatcccagctactagggaggctgaggcaggagaatcgcttgaaccagggagtcggaggttgcagtgagccaagaccatgctattcactctagcctgggtgacaagaaagaaactctgtcacaaaaaaaaaaaaaaaaaaaaaaaatagcgttcaggttgagaaatcctacagtgtaacagggtactagtgttaccccattttcaaaagcacaaaagatgcaggtgacttaagtgataagcccaagctcatacagctaggaagaagatgatgcgtttaaaactggagagtctgggccgggcgtggtggctcacacctgtaatcacagcagggagagatttgggaggtcgaggagggcggatcacgaggttaggagtatgagaccagcctggccaatatgatgaaatgccatctctactaaaaatacaaaaattagctgggcgtggtggcaggcacctgcagtcccagctactgtggaggctgagacagaagaatcgcttgaatccgggagatggaggttgcagtgagctgagataacaccactgcactctagcctgggcaacaaagcaatactgtgcctcaaacaaaaaacaaaacaaacagaacaaaacaggagagtctgtgtgcagagctccaatatgtaacccccacaacctcaggatatctgtgagatacacaaatgcagacgcaaatgactgttctgacagctaacgtagggacttcgaagtctctatcggtgtgaaaaataagaaacattttctgcagatgggtgccaggtaagatgggttcactttgaggaccttggtttaatcaggatatcaaaatttgttgtttccttgtgcttgtcacaatatcccattgttaacacctgccagcgttgtcatcctaaactgttgctgctgtttctgagatgagctacaacaggtgtgccaaatattgggccattagcaagcggtaattcacctgcatgaatatttatcgtcttgtaaggaggaaacaaaagccgtgtctactttttggaacatggtgcagcagtgtcctcgaaaccaaattgtttgagtctctcgcttatgcggaaggagaagggctcctctgtaattttccatcgggtggatttattttctcagccatctccacatcaaaacacaacactgacaggcgcttgattttattaagccggtaaaatcacccgacagtttagatagctcaagcctctgattatcaaaatatctattcttaaactggttttgaagccagtcgcttctccatggggaaatggccacaatgatgagcaggacaaatttttgcttttctcccctctaattccttccctccctgcctcctccttctccttgtcttgttctttttttcgttccatttttctttttttactgaaagagattgtattaatgaggaaagaggagaaaactcagaaacagataagaaagagtggcaccgaggcttcttgtacaagggtgattgtaaattttatgtcctcagtaagaaccccaaggcgtgtgtgcttttaaacaaaaagaaagtctaagggagaatatgccatttccacgcccatgttactgctgcattcgcacctgtcagcactgcggcctgtacctccttgtccagcaataccatactaataacataccttacaggatacacggatacatcaaacaggttgcagtgctggtaatcactgacttagaaaccaaatgtgctgtcctgaatttttaagtattgccatgactaaggaagtaatgatggattcccaataagtgtgtttgccatttgtgtttggatatcatcactaacagtaactttctgtgcatattttatggtgatcacttatgggatcattccttaccttaaatttgtgcagatcattcctctttctttctttttatttttttgagacagagtctctctctgtcacccaggctaaagtacaatggtgcagtcttggctcactgcatcctctgcctcccgggttcaagcgattctcctgcctcagcctcccaagtagctgagattacaggtgtgcgccaccatgcccagtaaacttttgtatttttagtagagatggggtttcaccatgttggccaggctggtctcgaactcctaacctcatgatccacccaccttggctgtggaaagtgctgggattacaggcgtgagccaccatgcccggctgaattttcacctttctttccctttccatcggccctctctactgattctatgtttatacttgatcaaataagagtttcagttagtcaaatataaatgtgtttactttttttttttttttttttgagactggagtgcagtggcactgtgttggctcactgcaatctctgtctcctgagttcaagcaattctcctgcctcagcctcccgaatagctgggattacaggcgcccaccaccatgcctggctagtttttatatatgtagtagagacggggtttcaccatgttgtccaggctggtcttgaactcctgacctcaggtgatccacctacctcagcctctcaaagtgctgggattacaggtgtgagccaccatgtctggccttaaactcctttctttttaaaaaaaaaaaaaattaagttcaagggtataagtgcaggtttgttgcataagtaagcttgtgtcataggtttttttttttttacagattatttcatcacccagatattaatcctagtatccgttagttatttttcctgatttacacatgtaaatcattaacctaaagaaagcaaaagacagaactttcttctgagaaaggatgtatgttttcccttttggaaagttgtattaataacatctaatccttggggagtgctcagaaattattttctgaaagaatgaatgaatgaatgatcaagatcaaataagagacacaggccaagccttcaaacaagttatactgaacccagagggttccctcaggctccttactgccatgactaagtacgaatggtaagtaacatttgctaaggacttactggggagtgtcatggtttatgccatttaacctcatgagggaggcacttatatttcccctattttaccgaagggtagctgaggcttggagagaccatatggcatgcccattttagccagtgagtggccgggtctggaaataaatctaggaggtgtgtcctttaaccactttgtagaaccattctcattatagtaatggagaaagaacagaatctcttatggtgacttctaggactaagggcacataataagagctgctatttggggaatatgtctataaacctgggagttataaagtagggtgagaaatgggggtgcattatgatgttatctgagagggacttggaattcacatcatctacaattttggacagatgtctttctgcaagccttattttttttttttttttttttttttgacagagtctggctcagtcacccaggctggagtgcagtggtgcaattataggtcattgcagcctctaactcctgggttcaagtgatcctcctacatcagccttctaagtagctgggctacaggtgcatgccaccacacctggctaatttaagaagtaaaatttttatagagatgggatcacactatattgcccaggctggtcttgaactcctggtccttaatcagtccccctgccttggcctcccaatatgctgggattacaggcatgagccaccacgtctggcccttcatgcaagtttgatatgcttttccttcactggggctttctccctgagtattacctgaaagtcagaaaggtcctatgtggaagaaccgttgtattgcaattactggggagcagaaggaaagtgattttggaaaaagcgtatgtatgggcttggaaacttttccccagaacagagaccatttgcagacttttcactgtggccgtttctcccagtcttgatagcctttcacacatctccagggttatctttgcagtgactcagtcattattctacaggccagcatgatttttcttaaattttctaaacctttttccaaaccttcaattttataaaatgtgacacacattttgacttcttttataagacctaattcgaatgccccctcctttttgaagcactccatgatttttttctactgtccaggtatatgctgtggtatcgtattgcagagtcattactctttgcctgactggcctggaattgcctgttgacatacagtttccctgctggaatgtgtgagctctctaaaaagtgtggagtgtatggcttggtttgttcattcttgattcatcactcacgtgtgtctctaagtagcagctgctcaataaacattgaagggaggcagagacaagacagtgctaagaaaggaatgaagacaataagcaaaagttaattcaagtacatttctaccaaatttccggaaccagattcctaagcagtggaggcagaggagaatgaaaaggtagagtgggccccgtgccaatttcatttcagaaaacattcagagagatgcttccctgcgtggtgtggttgcagagggcccacctgtacatctgggatacctacaggcatcccaccattcccgttcttcatagactatatgacacatcccagtcgtgttctatcttttacacgcagcacacacaccgcaatttttgccttgctgagcttttaaaactcttattatctcagattatgaagacaagctgtgcggggtataggcatgatctcaaactgagttaattgaaggtggaggtcagttcagctttcctggaccatcaatcagtaaaaagtttacttgtttaatgcacggagagtcaaagacatgctgcaggcccccccatcccttcccttctggcctgtcaggtagatgttagatttcactgagctgttaaaaatcttaatggatcccactgagctgtttcaggttgtttgtgacaatcacttaatttccttgttttgcagctaacaatgattttaatcttcatttcagattaaccacataaagcctcagtgtccttttctcccgttgtcttgcctgcttcaactctgcagtcgatgaaagggagaactctttccctttctcttcagcagagcctgaaaaaaatgtaccttcagcaaaattatagatgcagtaatttctcatatatgttaaaaatgcacagtagcaaagactggaaatccagcaaagtagtagtagcaattgcctccaggtggttagagtgtggggagattttttttccctacctctttcattttttatttttttacactttcaacattttctgtgatgcactttataatttttacaataagaaaatgtaaattaaagaattggtgtttctgaatcaaggatgaacaaagaaaatgtagtcttttgaagagatgttaagccagatatttttctactttaaagggtggagaaaaaccacatcgggataaaagagtgaggctgcagaattagcttgcaacttgaaggatgggccctattacagataatgctgctgacagcctcagttcatcacgtttctcatttttagtgtattggtgtttgctcatatgaaagttcccagcttgtgctactaattatttcatcaccattcacttgtacaattgacagcctttgaaccaatatcagtgcagagaccagagaaacgattctgagagagatgattcaagaggcaaagattggggaaatgaagaagacttatttggcactctctgagtgctttatgtgtgggatgagggtgacatagtgcaaggagtaaatagtgttgtcattttaaaaggctagacctgcatcaaagggcacttactgtaagcctgaaagtgggtggactgaagggctctttcttccaatggccccttgttgcagcgtgaacatctcccatctttatattgtgatggcactattcctcaatggctaattgctaggcaatagaagacataatttagactccaatttgtaagtcaatcacatgaaggctggatgtgagcaagcttggagataaatgaaccgtggtgtaaacaagagaggcccagaggcttcttgatccaatttcaggaatcccaggctaccctgatgcgttggttgagattacatcctctccttcgggaggggacagagggcagcccgcatctctgctcttccatctggagccgctctctatgggagaaggagtcttgagccctttgttggctgttgatttgatttttaaaaggaaaatctgacaaatcatgttgaatgagaaaagcgtattatgtgaacgtaaaaacgtttgcacatctgaggaccacgcgattttattcaaggaagttctacctttaaggaggttatgaattctgaatcagaattttgtcgtcaggggaatgcttcttagaaggaaggaaatgtactttttaacaagattttcagcaaacgttgacacattcattatggccatgagcatggaggtggctcaaatatattttgcataatgtggaaataatattgcattctatttgttcctgcctcctagcgtcaccacgaatgacactggcacagaagaaaacatgggtgctttagatcacacacacaaaaaatgatcgggataaatttaacacactaatcatcgtgaaggggcttctccatgtatcttttcaatacgcaggtttatctcaaccttggcccagctctgtgcagttttataccataaacccagtcagactccgtcttatgctaaaagacctcccccctcctcagtcacaaatcccatcaaatagactgtggtcccatttcctggtcctgttcctcctgtttagggaccagaccttttttttttttttttttttgtggagtctcactccgttgcccaccctggagtgcagtggtgctatctcggctcactgcaacctctgcctccaggattcaggcaattctcctgcctcagcctcccgagtaggtgggattacaggtaagtaccaccacgcctggctaatttttgtattttgttagtagagatggagttttcccattttggcctggctggtctcaaactcctgaccttacgtaatctgccaccttggcctcccaaaatgttgacattacaagtgtgagccaccacgcccgaccacctctccttttttttttttttaactcaactttctttagattcaggggtacatgtaggtgcaggtttgttacatgggtgtactgtgtgatactgaggttcggggtgtggatgatcccatcacccaggtagtgagtgtagtacccaataggtagttcttcagcccatgccctcctccctgtctttcccctccagtggcccccttgtctattgttcccatcttatgcccatgtattagttcacttgtattagtccattctcacactgctataaagaaatgcctgagactgggtaatttttaaagaagagaggtccatggttctgcaggctgtacaggaagcataatggattctgctcctggggatgcctcaggaagcttccaatcatggcagaagacaaaggcggagtaaggtgactcacatggcaggagcaggagcaaaagagaacaagaggggcggcgctgaacgcttttaaacaaccggatctcaggggaactctttcactagcacaaaaatagcaccaaggggatggtgccaaatcattcctgataaatccaccgctgtgagccaaccacctcccaccaggccccacctccaacattggagaccacaatttgacatgagatttggcaaggacagagatccaaaccatgtcaaatgcttagctcctacttacaggtgagaatatgcagtattcagttttctgttcctaggttaattcacttagattaatggcctccagctgcatccacattgctgcaaaggaaatgattttcttttttatggctgcatagtattccatgctgtatatgtactacattttctttatccaggccaccgctgatgggcagctaggttgattccatgtattcacaattgtgaacagtgcagaactctcctttcatcattgtttttcctcccaggttgctgctgttcacttctctgtccagtctgtcaacacccaactttctctgataacaatacagtgtttgttgtatctgaccaacattttgttcggccttccgcaagctgcagagaaactttttgagagtttgataataaatcttgccatgatccctgtaggaggcacgtcttcctgaccaggcgtggtggctcaggcctgtaatcccagcgctttgggaggccgaggcaggcagatcacctgaggtcaggagtttgggaccagcctgggcaacatggtgagaccccgtctctactaaaaatacaaaaattaaccaggtttgatggtgcatgtctgtaatcccagctagttggaaggctgaggtgagagaattgctcgaacctgggaggtgaaaattgcagtgagccaagattgtgccagtgcactccagcctggctgggtgacagactgagactctgtctcaaaataaaaaataaaaaaaaggaagtatgtcaagtatgtcttcctacacaggggagcagagaaagaccaagagcaagacacagtggaggagcagcactgatggagagacatgccccagaggacgtggggaggtgtaggaatcccagccgccagatgagagttcagctacgacgcagcactgcaggcccaggaaggccatggtccagagggaatcagaacagaagagaaatgaggagcccagataagagatccaccctgaatcctagtaacacacagagggcggggagctccggtcttgaggctaggaaacagtcttgcatttgggcaagttgtccttgtatgaagtgccagttgtgtccaggcgtggtggctcacgcctgtaatctcagcgctttgggaggccgaggcaggtggatcactaggtcaggagttcgagaccagcctggccaacatggtgaaaacccatctctactaaaaataacaaaaatcagccagatatgttggcatgtgcctataatcccagctactcgggaggctgaggcaggagaatcacttgaacccaggaggcagaggttgcagtgagctaagattgcaccactgcactgcagcctgggtgacagagcgagacttgtttcaaaacgaaacaaaacaaatgaacaaacaaacaacaacaacaacagaagtgttgcctgcattaaggaggcagtctaagctgtctggcaacttggaggacaagtatcaaagataaattgagattatgtctcattccactgggtgcttccattataatattgcagtggttatcaataggcagtaatcccgtgtcccctggaggacatctaaccatgtatggaaacatttctaaacattaaaagtgaaggaaaggggctccaggaatgctactgctcagcatctttcaggacagccctcactttaaagaattatccaacttcacttgttaatagtgctgaggttgagaaaccctagtacatcttaagagcactgtgtgtgtgtgtgcgtgtgtgtgaacgtggggagataattataactttgtaaagatggatctacaaggatgttcactgcagcattgtttacagggctaaaagcataagcaacctcaatgttcaactatagggatgtggaaagacatgtaataattcctcttctaagatgaaatgacgttgcaaccatggtaaataatgccttaggttaaggttcaatgggatggaagagtgttcctgagatgctattaaatggaaacaaacaagttatacaacactatttgcactatgttttactttcgttttgaaaaggctatctatagatatttgtatttattgcatctaagtcgacataccaaacagaatacaggaaaaaatactctacaatattattattacttggatattgaagatgtggatgaactaaatattttcactatgtgttgtttaatatctttgcagatttccacaaataatttatttgactttaataataaggatgaaacaactttataccttttagtaatattatttttcaaagcatggagctgaaatctgagtagatagaggaaccaggattttctgtcctgggttgattttttagccagaatctacttccatatgcagacaggaaggagagtatggtcaacaggtatgaagtttggggagggtaacattgggctctcactttaagcattgatagctaagctgaaggaggaatactctaaaatcattgtcttctcatttaaatgctcttgatcaaattaacagcctctcctgaatattccaattatattaaaaatggcagtagtgttcaatttgccttctgcacaccccctacccaacctctcaccatttctgtgggcttgggattaggcggtgctgtgttgtgtataagggtcagtcttatagggcaggagcctgggctaatagaaagactgtgacttcatgttcctaccaaagaaaaacaagtttatctactgtatgtggtttatcactattttttttttgtgaagaaaattgtttgttttgaaaacagtttgatggactttgtaggcatttctgtggggaagatttgtattgcctggtttattctgtggatctaattcatacacacacacacacgaacgttttgatagagtttgcagagtttgcttctgtttcagaaggtttaaaatttcttttattcagggagaaagagtttaatcaccattactctttttacctttttatggagggaaaatttacatagcataatgtcaatcattgtcaagtgtacaattccgtggtatttagtacattagcttcccaaaaagaatcccatgcctattaagcaacccctccccatttacccctcccccagcccctggctaccactaggtacacctcatctatttaatgttactgaattgtagaatcttgttggcattttactttctattgtagctagctgtttctctgtctctctgtctcattttctccctctctctctctctctctctccctctcattgtctctctcttattctctctctctctgtctctctttctgtctttccctccctccatccctcctcccttccttccttcgttctgtccctctttccctctccctgtctatgcaatagacaaacatagaaaggcaggttcaaaaacagatggggagatgaagagaaagagagaagggtgaagaagggagagagagaagggagaagggagagacagaagagagagaaaatgaaagtaagagaaaaagagggagggagaaggaaagtgtccaggaaagagagagaaaagaatgcagaggacaagaggaggggaaagagataatctaggagtcggagaaaggcagggtaggttttgaaagaaaggactaaaataggcctggtgtggtgatgcacacctgtcgtcccagctacctgggaggccgaggtgggaggatctcttgagcccaggaggccgaggctgcagtgagccatgattgtcccagtgcactccagcctgggcaacagaacgacaccttgtctcaaaaatcaaaacaaacctactccttctcacaggcacacctcagaaagaccggcagagaggcccctatacccccattgagacagaagcaatttgaaagaactgttctgaaatttcaaaagtgtctcatcatccagagaatgaaaaaaggaaagtaggttagacctgtcttgacctctgcaaattcctgccacatgtctcctgggttctgcccatagcaggctctagctctcagtggtgtaaacttcttgagcatttgggggtcacgctgtcatccctggagtcctttcgttaatgtcctgaaaccaactctccatcagtgttttgccttttcagtattctatctcgctgtataattgagtttctgtgattccaatgcagactatggcatgaactcctgtgtgtctagttattatagattagccctgctgatattatgaggtagggaagggttgatatgctgtagagtgacacagaaacccgataacaatgggaaaagagagtttcatataaatcttcttaagtatagtatttccatattaaatgttataaagtgaaggtctggctgcattgataatgtgccctctgctgatggaatgtgcttctgccctcttggcaggcttcctgtggatcctaggtgataaaagccgtccagagtatttcttcattatcatcgtcatcttatgtttacattattctccttgtcactgagaactccagaccccagtctataggaaacggttcccacattgttgaaatatggctggtggtacagggagtagttctgaacgctgagcatggcctcatttggaatattttatgcaatgaaagtgccggtgagaatttagacagcaaagcttaccagtatgaagcagaaaaaggcaaaataaagaggcgtatgtatggacattgcattcatgcatttgtgcccaatggtgttgaattctccttacaccttaatgaaagagtaaaaatgttgaggaggacgtggagctgccaagtaaggtggattattttttgcaaacaattgtattaccattatgatataatgtattactagtatgatataattctatctgccatgatgtgatatgatttataatgatttaaacagttgtattatcagtgtgatacaatggtaggatgatactataaagagatagtgatttcagagtattgcacaacctctgaagccatttggcctgagttcatgctcttggttcacccgttaccaggtgtgtgactgggagcaaatcacaccctggtcctcagttttctcatctgtaaaatggaataataaggataatttatagtattgctgtgagggctcaggagttaatgcatgaaagcacttagaaatgtgtttgatgagaggccgggcacggtggctcatgcctgtaatcccagcactttgggaggccgaggcaggcaaatcacttgagcctgggagttcaagatcaacctgggcaacatagtgagaccccatccctacaacaaatacaaaaacacttagccaagtgtgctggtgtatgcctgtagttccagctacttggaaggctgaggtgggaggatcacttgagcctgggaggcagaggttgcagtgagctgagattataccactgcactccagcctggacaacagagggagaccttgtctcaaaaaaaaaaaaaaaaaaaaaaaagtgctcgatgcctagttagcattccatacattgactattaccattttcattattattaagttcatgtactgaaaccttcaataaaagcagtatttactgggtggaatacaaaactaatgtatgtgtatgtagtttatttatattgtaattttttattctgtataatagaggcatattctgttattaaggaagtaacttgtgctttctgtgccttgattttctcatctgtaaaatggaagtaattctgttactttatagggttgttatggtgattctaggaattaatgtatgtaaagtacttaacacacactggataataagcttgctgtcatcatcaccatcattgctgttactattatctaaaagcagctcacgtcctgaaatctacagtgagaagaatattcactgggctacgtaaacaaaatatacatgctcatctatatagttctttgatataatcatttttattctatataatacaagaagttcaatttttgagtcaaaatggcaatgggaagtctaaattaattcaacacacaaacgaggctgtgattgtttgttttactagagatttattagctttatcaaagtatcgtgtaggaagtagtaaagcgtattcttagatcacagcgcatttgagatgtggttgggtttatggacctgcggcgtgcacagacttgtctgggaggtgcacattcggtgacatgcacctgctctgtgctgtttcctggaagaggagaaggtgcgcccctcccactgattaggcaggcatccttgtgtgggggattaaggagcatattcagttattagctgtgaaatgtcgtggctgcctctgcattgccagctgtgattggtgctggattttaattatcatcaagcaagttccaaatgtttgaaatgtgtctgtggagagagctttggtggagagtgggagaaaaggtcttgatgaaggagcaaaaccttggcatcagccgtgcacacggccctgggatctttgccagctccccaccactgctgctgcagggtttcttgttgaccctaggggctagccccttccattatagaataacaacagttgtcagaaagccatttctcatatttacccaacattcacttttctatagatcctaaaggccctggtattttctcaggtgcaatgcagatgattcttcattcattcatccatgtgcacctctttgtctgtttgttccttgttcaataaatattatgtcaatgcctgctgatatggtttggctgtgtccccacccaaatctcattttgaaatgtaataatccccatgtgtcaagggtggggccaggtggagataattgaatcatgggggcagtttccgccctactcttctcatgggagtgaataagtctcatgagatctgatggttttataaatgggaattctcctgcacaagctctcttgcctgctgccatgtaagatgtgtcttgctttcccctttgtctttcgtcatgaatgtgaactgtgagccaattgcacctctttcctgcccagcgtggtggctcatacctgtaatcccagcactttgggaggccgaggtgggtgaatcacctgaggtcaggagttcaagtccagtctgaccaacatagtgaaaccccctctctactaaaaatacaaaattagccaggtatggtgacacatgcctgtaatcccagctacttgggaggctggggcaggagaattacttgaacccaggtggtggaggttgtagtgagcctagatcacgtcactgcattccagcctgggcaacaagagcgaaactccatctcaagaagaaaaaaaaaaaacagaaaaacaaacagaaaaagtctttcctttataataattacccagtcccaggtatgtctttattagcggcatgagaacagactaatacacctactgtgtgctggctgaggttctcaacgttgtgctgggcaccagggaatataaaacagtaagactcagtctctcctcttgaggagctcagaatggatgtggccggggaatgacaaaatgctatgatgtacaaatgtgaacaattagaatttgtacaaagaaaggaagtttggattaatgctgtcagagtgcaagagcttggggattcttcatggaaaagatgatgccagagaagagctttgaagaaggaaaagggtgttttctaggcaaactcaagtggagttgaattaggagagaagtgcgaagacatgacggatggatggaatgacacaggccaaagaatggagttaggaacgatgtgctgtgcttgggagctgcaagttctgctgacgggtggagagtaaggccaggtgtgagaggaaacaagccagatgggggagcgggatggtcacataggctttgaatgctgtgatgggaagtttagactttacctggcaagaggtagacaaccaccaaatgcttggcaacaaggttctatttgcattttagaaaggccactctggctgcagtgtggatgataagtcagtggatacaagattaaaggcagggagactagtcaagaagttactgtggtcaggaacagtagctcatgcctgtcaccccagcactttgggaggctgagataggagggtttattgaggccaggagttcgagaccggcatgggcaacatagtgagtcctcatctccagaaaaaaaaaaaaaaaaaaaaattagccaggtgtgttgctgtgcacctgtagtcccagctacttgggaggctgaggagggaggattgcctgagcccaggagtttgaggatgcagtgagccaggattgtgccattgcactgcagtctgggtgacagagcaagatcctatctcaaaaaataaaattaaaaagatgctactgcaatggtctaggtggggaaaggcaggtgattgcactaagttaggggtaatgggtttaggagaagcaggtggtttgaataaagttaggagggagaatagaggatcctatggctgtggatgtggtgcaaagagtcaagaaggatacctgcttctagcataggtgaggcaggtggatggcaacagaggaaatatggaaagaaaagtctttccacaagccctggaagagggagggaaaaggagcgttttggtggcatgcagtgacggtccagcccactacctaagcccaggaagcgtcacgtggtacttctcaacaggcagaccaggtatctgagtaaatgtctgctcagttggcaggtgtcagagaaatctacaagcagataaaacaggggctccgagggtgtaaatggtgggatttgaaggaaggtgagtacaaagatgatgctgggggtaagtgtgagatgtgaatggcatgaggtcttggcaggtattacaaggacttgggcacttagtctgaatatgatgggaagccagccatcacaggattttgaacttccaatggggtgctcctgtagtcctggctactttaccagctttgtgacttggagcaaatcattcttggtgactcagttttctcatctgtaaaatggggctaacactggtcatttacagagttattgtgatgatttaaggagtttatttatgaacatgtccagaaatatgcttgcttgcttgctttctttctttctttctttctttctttctttctttctttctttctttctttctttctttctttctttttcttttttgaaatagagacagggtcatattctatcaccaaggctgtagtgccactgcacgactatagcttattgtagcctctaactcctgagttcaacggaacctcctgccacagcctcccaagaagatgagactataggtgcataccatcaggccttacctatttttgctttttaaattttttgtaaagatgggggtctgactagttttctaggctggtcttgaattcctgactttaagcagtcctcccacctgggcttcccaaagtgctaggattatacgtatgagccacgttgctcaccctgaaagtgctcagaaacatgcttcaggcataggtagtatttaacaaatttgctattatcgtttacattattttacctgaagcttgtatctcaaaatcttcaataagaataatatttaatgaggccgggcacagtggctcatgcctgtaataccagcactttgggagggcaaggcgggcggatcacctgaggtcaggagttcaagaccagcctggccaacagggtgtaacctcatctttactaaaaatacaaaaaaaaaaaaaaatgagcggggtgtggtggcggatacctgtaatcccagcttctggggaggctgaggcacaagaattgcctgaacccaggaggcggaggttgcagtgagccgagatcgcagcactgcattccaggctgagtaacagattgagaccctgtctcaagaaaaataataataggctgggtgcaatggcttatgtctgtaatcccagcactttagaaggcaaaggtgggcaggtcacgaggtcgggagttcgagaccagtctgactgatgtggtgaaaccccatctctaataaaaatacaaaacttagctgggcgtggtggtgcatgcctgtaatcccagctactgaggaggctgaggcaggagaattgcttgaatctgggaggtggatgttgcactgagccgagattgcaccactgcactccagcctgggctacagagtgagactccatctcaataataaaaataatgataacaataacaatatttaatgaaataatcatgctgtcttacttgtgagatgccatccttcgggctgttgatttgggaacagagagaaagtcaggggagaaagtcaggagctcagatggaagccattgcagcagttcaggtgggagttgatgctgccttggccccacatggggctatggatacagtgaaaagcagtcaggtgttgtgtaggtatagctgatgggagtttttggcatagcaaatgagaagtcatagagaaagacaagagtcagaaatgagaagcagagaaggtttgcttcatttcagcattatgttctgttggatgagcaacttttaaaaatggagccactatttcagttatcacttccaccagacactgtagagcctctgtcttgaagcccctgacctgcccctgggtgtagcccatcacctttctcatgggactcagacatgaatgcaagtgtggggccagaggccagcctaggagtgagatagactcgctattctcagaatttcccattcctctgtatttcatagtttctcattggtgctgtaacaaattaccacaaattcagtggcttaaagcaagaaccttatgaacgtattatcctcgggttctagagatcagatgtctggaaagagttttagggggataaaatccaggtgttagcagggctcagtttcttccggaggctccagggaagaatctgttttcttgctttttcctgtttctggggactgccactttccttggctcatggtcccttcctccacccttcaaagcacatcactccaacctctgctccatcatcacacctccttttcctctagctccaacctcttttcatttttcttttttttttttttttttgagatgggggtctcactctgtttcccatactggaatatagtggcaccatctctgctcaccgtaacctccacctcccgggttcaagcaatttccatgcctcatcctcccaagtagctgggattacaggcatgcaccaccaaacctggctaatttatgtatttttcatagagatggggcttcaccatgttggtcaggctggtcttgaactcctgacctcaggttatccacccactttggcctccgaaaatcttgaggttacgggtgtgagccaccgtgcctggtcacttctaagggcacttgtgataacataagacacacctgggttatccggaataatctccccagctcaatatccctaattacataacatctgcaaagtccatttggctatgtaaggtaacacattcagaggttctggagatgaggacatggacgtctttgagaaaggccttattcctcctacatctccaatggccaaggcttccttactggcatgggttccttccccagcttcctcttctcgatggccatgaaggctcctcagccttcctgcaaataggcccatcccacagtttttcccccgtgcctgactctcccttagtcttgagctgaaagccctcatttgtgaactgtgtattcatttaactcgattagctcatgtatgtaatgcacgtcgcatagtgcctggcacataggaagcaacttctaaaatagaattcagtctataaatataattttgaatcatggttctgtcactctgcttccaagctgactatgggtctgcaccatctgtaaatatgataaacacatcttctcaggtcatcctttccatcattgataaaaatgtccaactagacagagaactctgacattgctaacagcctataatctgtttataagtattttatatattttttagagaatgaccacctgcatttccaatgtattcttctcttccaatgatttgtacctcatgatccttcatttggcatttactgagttattactatgtgctaggcaccccaggaggttaaatgataaatgacaaacatgaggccagcttccaaggagcttgtgaatcatgctggaagatatgtacatatacgtgcacagctgttccatttattaacattctttggataaattgatggatcagccctgagtctaagctccagcccacattcctcattaattccattaatactgcaatacactcaatctatagcattagtcagtcgaagtgtctaggacctcaaaggaatggaagaggatttgcttgccatcactttttcgtagtgaacgcatgttaccactgaaggatcacctttactcattcagagtggtttcaaggcaccaattagcaaactgttgtgtaacagatgttttgtgtcattgctagcactcattttgttattgttgttattgttgttgttttttgttttgtttttgtttttgagacagtgtctcattctgtcgcccaggctggagggcagtagtgtgatctcggctcactgcagcctctgcctcccgcattaaagtgattctcctgcctcagcctcccgagtagctgggactataggcatgccatcacacccagctaatttttgtatttctttttcattagaggtggggtttccccatgttggccaggctcgccttgaactccttaccttcggtgatccacttgccttgtcctctgaaagttctgggattacaggtgtgagccaccatgcctggccagtattcgttttatatagcatctacccccagcaagatttatagacactggggcatttacccatttccaagtggtttgccttctcttcagttacctataatcactgcatctaattctgaaatcataatgtttgcaagattttatggcacctgggacacaattgattggggtctagattgttcattttaatcaaagtaggagctggtgcctatgtggtagtcaaacagtagatggacttatctcacatgtgccattcatcaaattccaatgttccatacatttatgaatgatctgtgacacacaccatgacttctgttgcatcgttttcccaccacgaacttcacttagcatgtgatggtttttcattcttctctttgttgtttggaggtcattctcttggggcaaaagttaaaagtcaagttagaaatggttaaaatctgcattttcaacacattggagaaaaactctggctcctggaaacagaatgaggaaagcatgaaaatgtggtgaatactttaaaaaagaaatatgcattttctcttctggttaaaaagataaatgcagctcaatacagttaagtaaatgttatacctgctttaagggtgatattgaccatgggaatgcaagagctacccgaattaaaaatggctgttggaatggtaatgcagtatcttgaattaccagtgaaattacttttcctcctcttaatgccttttctctgttagtatattttataccaccaatagccataagcacataaatacctggaagattcagtcctgtcctgtgctaggctcttgctcagaaaacaggtatttaattcccttatacatgatacagaccaaattgcagttgttgtaaaacatgctgtgaacaattttgacagtatcctgcctggtttttcttcacttttttttttttttttttttgccttaaaaagttttatttcacatataggtccaagttgaaatattattttttctggggggaaaaattaccaccccaagcccagtttcttctcaacacttactgtctttataattaattaatttgttgatgatttttctgtcaataccccaatggactgtaagttacataaggaaagccatgataatttgtatccccaaaccaaacacagtttccgagatgtagtagtaactcagtgattatttgttggatgaatgaaaatagacacaaaatggtacacgtatattgaataaattagggttatggaaaaggtcacatttctttaggaagtttgtagaggtggtgacatttaagcaaactgataacatagggggatttattataaattttctctccagtcgatgggcatagacatacttcatcccttgcaggcccagaatccgagatgtctatttttgacttgctatatatagagagaagaaacagtccctctgaatgtgaagttactcagtatttttggctctttggctattttcaaggttcttcatctggacttaaaaaccaaattaataggcgatcgtttcctcccatcttttgcacagacactattttaggagaagaagatctatcacccacagcatgtcagtgaacgaaggggctgtttttactgttcaatcaggaatgagcgtccacagcatcgttgctcacatactccagtaattccctactgacctgcatttactttatttaattccattaatttaagctaaatgaattttatttttaaaatgtgtctgtgcagaactaagcacagagagcatatttctgtttaactccttttgtttgcagcttgaaaaccaatttggatcttttattttcttttcccttggttctaagctttgcttggtcagtgtcttcagcacctaatttgacaattaaatgtatttcacaacccactgacactgcttcattaggttctccaggagtcatcatttccctgcagcctcattccagtcatttctaatagatggtgtgtgtattagtccattgctacactgctatgaagaactacctgagactgtgtaatttataaagaaaagaggtttaattgactcagagtttcacaggctgtataggaggcatggctgggaggcctcaggaaacttacaatcatggtggaatggcgaaggggaagcaagcacatcttcacatggtggcaggagagagagtgaagagggaagttttacagacttttaaataaccagacctcgtgagaactcattcattatcaggagaacagcatgggggaaatctgcacccatcattcagtcacgtcccaccagctccctcctccaacattaagagttataattcaacatgtgatttgggtggggacacagagccaaaccatatcagcatgccaatgaggctcttctgatgggacaaggaaactgccaggctcctcttggtcttgactcttgtgccaggaaagagtagctggatttcatcccaatgccgttcaccctggggaatacctgggttaagagagtttgtatttctactgatgtctcatcaaagaccttgctatttatgctgtccatatcggtgtcttttgtaaaccgaagttggaaagaaatgtttaaaaagaccgtacaatgtaataattactaattacttgatagccagcacttaataaatgcctgacgctgtgctctgtgcctcacaggtattaactaaattgtatcctgagagaaacctgtgaaaggtgtactgttgtttctatgttaaagatgaggagagtgaggcttaaggagagtaagtaatctggccaggccacttacctaagaagtggtggagttggactcacacccaaatagtctgatctccaaactttgcttgaccacatcctgtagcctcttggtttcatggcatagggctggatgctgtgtgctttgctagtcaattttagtaaagactttagacattgtttggtagtggactgggatcctcaggagttaatcacttttactgtttttaagttaccccgggatttatcaaataaatcgaattacttacagttcttcctctagctataacttatttgaaccctctgagttggggttggcgttgtttggtcacagatgaggagggcaaagtcaagaggcagatgttcgggctttccatagacatttcctgagcctgtataagagcctcaccatgcatataagcaatgcagtggttactgagacatgcataatgctactaggacattatgcatgataagtgttttttctgtgtgtgctcaccactgtacctgagtattcttaacattgtgcatggtactttgttagttatctgcaatatcatatgtgctgaattttgcaactcataatatggacagttgatgatttagtgtatgacatcttccttttgcattgtcactgctagtggcttgaagttctgcacccttagaatagcctggttttctgtgggtgtgagagatgtcctggaaactgaccccagttgaaaatcaatctagcctgtttttgtaggacaactctgttgtgaaaacctatgcactcaagggcagctggatcccacttgagcatgccgatggccccttgcagtttgaagtttgtgttgtcatgaggtcagttgcatacaggcagtgatgatgagactacaggacaggcagggcagatagcacatccttcggcctctgatgaaagatgcaaatggaaactgcagtcaggaaggtataatcaaacaccatccacccatgttaatgcagattgtcaggacggccaacctctcctttccccaggagtgtcacaggcatgattaacgtgctctgagttcagcagaaaccactgtggctcttaccccgggctgtgccttagctcaggcctaggtgaaatgcctgggcaagtgatgggattgtcgaggaatgtggaacatcccctgcttcccttctgcccctttcctcatgcctcctgagctgccccagtcatccaacctgcagtttgggtacagggaagtgttgactggagttcagtgcaatatacccttcctgatttcttgacaaattgtttccccgaaccactattctctcctgtgtggctcagaactacttctagttgctaagcaacccacaagcagctgtagcccacaatatcttctagaggggtagacatattatttgggatacttctccagtctcatctttccctgggagatgtcccttcccaagctctggccttccacattacaaacacacctgaatgaaccaaggtgagcatccgacccagggatgcagctcagatgggatgcagaaagctgggccaatttgatatcctctttaaaatttcaatgaaaatgcaaaaacaatactcagaaggtcttaaactgaaatactgtgtagacttgggacttaggtggccattagtcttactctgtcacccaggctggagtgcctcagctcactgcaacttccttctcctgggttcaagcaatcctcctgcctcagcctcctgagtagctgggactacaggcatgcaccaccatgcctggctaatttttgtatttttagtagagacggggcttcaccatgttggccaggctggtcttgaactcttgacctcgtgattcgtccgcctcagcctcccaaagtgctgggattacaggcgtgagccttaggtggccatttctaaatatacatgtattgatgagtaagcagagaaaggtgtggtacatggcatgaaataggatattgaagagaaaataaagaagatggggcctgtgggatgggagaagatggagagagtagtactcatctatgtctgcaaggtagctgggcttaaccaagcttataatttgtccaggggaatctgggtacctgccaggaggtggtttctgttctggcctatggtatttaggctgagaaattaggaaagagactatatgacaagggtagtaaagactaaaaggattggccgggtgcagtggcacatgcctgtaatcccagcaatctgggaggctgaggcaggcggatcacgaggtcaaagagatcaagatcatcctggccaatacggtgaaaacctgtctttactaaaagtacaaaaattagctgggtgtggtactgggcatctgtagtcccaactacttgggaggctgaggcaggagaatcgcttgaacttgggaggcagaggtttcaatgagccgagatcgtgccagtgtgcctcagcctgggtgacagagcgagacaccatctggaaaaaaaaaaaaaaaaaaatcagtaataggatcaagagggtggtgatatcgaatgagtccagtcaagtgcaacagtgaacagtatggatgagctgggagaatagaaggcaatgctctaagaatggatgcttgatattcagagctggagagagggtctaggctgcgtctgtggagtgtatggctgaggtggagttggaagcaaacatgattggagtcagtgatgagaaagacaagggagaccaggatgttgagtgcaccgtccaagagtgatgaccagagtcatggcggacggagaggcagtgagcccagtgccgttgctctcattgaggaggatgagggaacatgccctggggggtggtgagtggatggcagctgtatgagggatggggctaataatgtctaatgccgctgatctcaagtgagccagggttctaagggaggcaggtgaagagagagttgtaagtatctctggggaacaaataggacccagacatcctaagggaacgagctctctcctgtgtacatagcttcccctaaagtcctctgctagattctttctctctgactgcttgtcagcttcgttttattttcttgtttttttgttttgttttgttttgttttttcttttttttgagacggagttttgctcttgttgcccaggctggagtgcagtggggcaatctcggcccactgcaacctctgcctccaggattcaagcaattctcctgcctcagcctcccaagtagttgggattacaggcgtgtgccaccgtgcccagctaatcttttgtaattttagtacagacggggtttcgccatgtcatctaggctgatcttgaactcctcacctcaggtgatccacccactttggcctctcaaagtgctcggattacaggtgtgagccacctcgtgcagtcagcttcattttctcttatttctgactgtctgtcttcacgtagccaggatatagcccatgttttacgtctcacagctttagcccttgaagagagatggactaaacactctctgtctcatcccaagtctggggaagacagtccttctctattgaattggatgcttatctctgactcaggcagcagtggtcagcgtggcgggagggtcttcctaatttgctattaggatgaattcctagcaagatattatggaatgacaattccacatgcctgtgagagtcactttctaaagattgctctgaggaattcataggctttgtttccaagcttttaattcttccaagcccttaactctcagtatctaacaaccttccctcacaggctgccgggtgatagaaagggtcattgacgtccagcccttcagcagccagtgagaatagcaggggacagagcttgacttagtggtagcttctcagaaaaattcctgggtgggactttggtgcttaaagggggacacatccactcgaatgtttgtctttctggttagaaataaacactgttggccgtgcacggtggctcacacctgtaatcccagcactttgggaggccaaggtgggtggatcacgaggtcaagagattgagaccatccagaccaacatggtgaaaatcctgtctctactgaaaatacaaaaattagctgggcatggtggcacgcgcctgtaatcccagctactcaggaggctgaggcaggagaatcgcttgagcctgggaagcggaggttgcagtgagctgagatcacaccactgcactccagcctgggagaaagcaagcctcagaaaataaaaaaaaaagaaaagaaaaaaaaagaaacagtgttcctctgctgtcttccttctcgtaaattaaaactgcctaacacaccttctcttcaggtatgcagaagtcgccagaaacaagtgttttgtgatatcagtctccctgtcttttctctttgtaattcccaacaattgaggctgtatttctaggaagtgctttgaaagacagcgtccccttctcttgtcctgccgtcattggtcaaaacattttggggaattgcaagggagtagtcagattcatcttttaacagaagaatatgaaaaccttggaatatgatatcagtttggtgcaaaaatgattgtgtgtttgccatgcgaaagtaaccgcaattacttttgcaccaacttaataaaaatgtatctttctgagtcccaccctgagacattctgatgtgaaagtgagtaccaggaatctgtacttggagccagggtctggaaattcagcaggacccactttggaaatattgctttaatactttattagaatggaacttggaaaacagttcccagcccccagttttccctgaacacctactgcctgtttttcacataggcctgggtgagctattgtatcccttccatgtatatgaaggaagcatattcctttccggctgaatcttggccatctcaaaggtgtgaagatttctttcctcccttgttttcctccctttcttcctgtaggattcctgcgtgctatctctcacgttcattctcttttccctactactacaagcaaagcaaacacaaagtaaactaaaatgccccttgttttataaaaatatttcttctgttgctcattttcccatcccccccatcctggccaagcatgccttgtttaggaggttttgcattgttttgatttctccttgtgaagcatttatccccagaaactctctagtacacaaggaccttcctgaaaatctctcaaggatgtgagcaggagccttaacaatacttgaaaatacccagtgtgctctgtaacttctctcccactggtaaacgatgtcctcacaagctcattgatgagagtctctaagatgtacttgttaccaaggatgcaattttaatcagtgatttataaaactgaaatgatagagaaaaatgctctttcatttactaagtcattctttaatttgttcatccagccatctttccatctgtccatctacccatctacccatctacccacaatctacctgccagcctacctatccatttacccatctctccatctagctatccattcatccatgcacccatccatccatccatccatccatccctccatccatgcactcattcaattaacatttattgaatccccatttatgttctacagtagagccaaaagtgatgatttgaacagtgttagtactcaggaaggccactgtcttggtgatagggatatataaatatatatgtgtatatgaacagatattgtataatgtagtggccctaagcacagagtcactgatattcacaaagcataatgtgaaatgaggaagttattcttgtcacgcactgcatcctcatcgattgctgtcctgttgtgaaccacggttgaagtcaggtgtgtttctttacttggttttgtcagtgtgcactgggcaggttgtaaataccacaagagcaggaacagtgtctgcttaattgaatatgctctccccaggacccggcacaatgcctggcacatggtggacgcccaagggctccaaaagccaatgttccaagcagaaggtttgacatggtttggctgtgaccccacccaaatctcatcttgaattgtaacttccacaattcctacgggtcatgggagggaacccgtgggagggaattgaatcatgggagtgggtctttctcatgctgttcttgtgataatgaataagtctcatgagatctgatggttttataaagagaagtttccctgcacaagctctctctctttgcctgctgccatccatgtaagacgtgacttattcctctttgccttctgccatgattgtgaggcctccccagccatgtggaactgtaagtccattaaaccttttttttttcctagtcttgggtatgtctttatcagcagggttaaaatggactaatacaaggcacaataagaagaaaaggccaaagaggccaaaatgcagagtctgtgtggctgaggagagaaagaaaggtatagggaggcaggggaggaaccaaaactgcttttgttagtgggtaaaatgcagagatgaccttctgaagggctggggcttggttctgtgtgagaacagggagtcacacacaggtttgaagcagaaaaatggaacggccaggttttcgttttctatgggttcctctgaaggctgagtggagaatggatttgagggagagtaaaactgatggaggggagggtggcagaagtcaggaagctgttttaagtattccaggcaggagatgatgagaccctgttgaggtggaaacagagaggagagatgtgtgggaggcattcatggcccaggcagaaggagagtaatgcagaatgacttctagatgttagacttgggatgatgggaggatgcaagtggatcagcagggaacatgagaataagagagaacagactgcagaaataataagtttagcctgagattttcttccttttttttatatatataattttttattatactttaagttgtagggtacatgtgctcaacgtgcaggtttgttacatatgtatacatgtgccatgaagattttcttttagagacttttgagaatatcacagggagacatctggtcaactattgcctttatgcatctaaagctcagagaaaaactctctcagttgaggttattgcgttgagatcaacaatgtggtgtggtttaactcatgattatagtcagttcctgcaaagagctggtatagaatgagacaagccaaggataaagtgggaaccagggaagcttattaaccttgcctctgaactccttttttttttttttttttttttgagatggagtttttttttgagatggagccttactctgttgccaggatggcatgcagtgggacaatctgggctcacagcaacctccaccccctgggttcaagcgattctcctgcctcagcctcccgagtagctgggactacaggcacacaccaccatgcccagttaatttttgtatttttagttgcgacagggtttcaccattttggccaggatggtctcgatttcctgacctcgtgatctgccctcctcagcctcccaaagtgctgggattactggcgtgagccactgcgcccggccatctctgaactctttaaaggtgaggctcatttgattcagcatccctgttaactatacacagagtaggtcctttcacttttttaaatttttttttattttttagggatagggtctctgtttgtcattcagactggagcgcactggcgtgattatagctcacttcagccttcaacttctgggctcaagcaatcctcccacctcaacctctcaagtagccaggaatacatgcacgtgccacctaatgtttaaattaatttaaaaactgattttaatttttaagcctagttaattttcaaattattcattagagccagggtcttgtcatgttgcccaggctggtctagaacttctgggcccaagcagtcctcctgcttagcttcccaaagtgctgggatgacaggcgtgagccaccacacctggccagtaggtgcttttaaaaatattattggtttctggagtattggtcaaaagttttaagattcccattgcatcttcaaaaggtagagaatttggtttaaatcacttcattgttttcggaaaaatatagattttaaacttaaaaaaatttctcatgtaagggacattcaagtaacatagaagggaccaggagtttggagtatgttatttatttactcaatatatatgtatcaatgccttctgtattcaagtgatgaatgtgggaccctagggggcagtgctggctaggaattatggccaatgacttaaacaattacttacagatccttggtttcttcatctgtaaaatgggaataagaacatctactttttaggattactattctaattaatttaagttaatatagattaaatagagttagttatatttactataaatgttattctaaatcattttatttatttagtgtctgcattataataagggctgaaagaaaaccaaagagagaggtgtcctgatgcaattatgattacattacctttgcttgtcagccacatagcgctctttttactgagacctaaaagtgtttggatttcccaaaccattgccaaactggtaggtgaggagcctctgtctagcatactaataagctaaggtttgtgttttgcctgtacttttcattttccaggaatgaaaaatacattttcactctttgtcattttaatgaaatcaagtctagggaaacatgaaacgcaagtcacattccttttcaacgggaaaacttcgaaaaccgcacaccagattgcgaactgttaaaattcattcattaaaagttcatggtctattggactttttttccttcaagcgttgcattatgtacatttcctatctgtgtttgtgtgacagattgtctaacagatttcttgtacagtggagttacagagtctgccagaaaggcctagtttggaacctgtggccatcggtgaaagggatttggaaatgccatcttgttagctaccggataatttagtaatcatggcctaacagatccctcaagaccaacaattacatacctgtttgaagctaattggactatacagaaatgggagttatatgaattatatgttataaaaatgaggtaggcgttaagtggactgatattacattctgaaacctagaatgactttcaatcattttagtgcacaggcttagagtagccaggatgcttggcggaggttgtctgtcatatcagagtgcctgtttttagaccgtgtgctaattctgtgtgtcgctatatgcatatgaatgcatactgtgtatctctacgtgcgcggacaaatcacatatttgtttacccttaaagtttgctgataacaagcgttaaaaattagaattcataatccagattttgaaagccgcctgtatgccacaccaaatgctgctgaagagttatgggaaggcttttatttttagcactcagtaaattaaaccttttattcatcattcccaaagaagagaacatccgttcttattaatttaaggaaggggaaagacagccgtccaatcggagtgaacctgtgtgttaggacttgttcaagggagtgacatcacacacgctgtcatccttacatcagttaattaattatctgtgttacaataacaagatatttcagacaagagtctctctctctctctcataataactttaagcatggtagttagagtgttgagttctggttgcaaagacatttcccttaattcaatgcattttctctgaataattcatgtttgttcgtttggtttttttataacatataactgatcagacatttttcttttttttcttttcttttctttctttttttttttttttttttttgagatggaatcctgctctgttgcccaggctggaatggagtggcgtgattttggctcactgcaatctccccctcctgggttcaagcaattctcctatcttagcctcccaagtagctgggattacaggtgtgtgccaccacacccagctaatttttttattttaatagaggcggggcttcaccatgttgaccaggctggtcttgaactcgtgaccttgtgatctgcccgccttggcctcccaaagtgctgggattacagacgtgagccactgcgcccaaccaggcatttttcaaccacagcagttttgacatttcgggctagatgaatttattttaggtatggacatttctgtgtatcacagaatgtttagcagcattcctagactttacctgcccatagcaccctgtgcagttgtgacaaccaaaaaatctctagatgtttctttttccccctaaatgtcacctggaggacaaaatcacccctgattgagaacccatgctgtctactcatgagactgtcatttaggatatcatcaactgaaaaaatgttaaaatgaaagtatatgtgcttcagttgtattcatcctgcagtatttttttgtgccttcagccaccttatcctattaaacattttccaaatgtaaggtacatatgtagccactatttttgtactggttctagacaatatattttattttgagttgagagatagcagccattttcagtcattttaaatttgattaagatttaatgagaagagaaaaaaggcatacattttcgtaaactaatttcagcagatgtgtggatgcttttatataaacctacattgaaaaagaaggtagcagttatcattaggacagaaagacataaagtcctatatttctgccattgtaagtatatgtacatcatacaggtctggaataaaaaaatgtaaagtgtttctatgacccttcgctaatcacagaggaccaaggaggagagaggaatggagactttggaacaggtcaagtgctgcacatagcataatatagcttccctagatggctctgtattaaaatctcagaattaagttattctgtcatcgactcattccgaaagaaatcatgcttgctcgtttctcatgtctacccttactgccttctgtggggcatccagatgtttcaaaggtctgaaatgtaacaattatgttgcaggaattgcagtggctttgtttcggggtagaacattccaggctgtgagtttctttggaaggcaggcttctgattaggtgttgccaaaggctctgcctaaacgtttgttttctgttgatggagtctaagagctgagtggttttattttcctagaaacagctgcttcctttcagttggctgaatcggaggatttattccccttttccactgcacacagagccttatgatgggcactgggatgtggaaggagtggtatcaaaggaaaagtcatcttgtctttcagtgtttagcgtcaacactggggtaaatctctaacgttgcattctggagtgctgtttaagagtgtttttattttctttgaattcaagcatactggaaagaaggggtacctggtggcccatattttattagcaacgtactgcagcctcccatcaggttcttgctaatgaaggtggcatggccccactgccccctgaatctgcaggaaagtggatatgagaggcagtattcaggaagattttgaaaaggatgttttcccttcatttctccagatgctgtaaaacttcatgctggatgatgccaggtcaggagagagctgtgtgcatggagtggattgcgttagttccctgctagaattgcttttattggattgcaatttggggtaatattaggagcccatctttaaggagatagtaagaaacaggcatgccttttgtgcctctttgaggaggtggtggggatatgtacatctcaggtcctctggcatggtgactataaatcctggcttccctgtgtttcagaacacctggatccaaatcccagctctgcttttttacctaagtattttttgactcctataagcatttgcttcctcatctataatatgagggaaataatagctcccacatcacgagttgtgaagctcccgataaagagagtgggttagtcacttacctgcactgaatgttcaaaaattgtcactatcctgcttgttacatgataaaacctccgtttgctccagccttaaggaataactgtgctaattttattggttatttattggtttattttcacaatataggtacctggaatggtggatatcaaccataagatttccttccatgccgattggtaggaaagccagcaggaaatgttggcctctacccagccaacatggagtgctttgaggtttgtgtgtgggtattaacttcattcctggcttcagtatgtttccaacccctgtttccatttctttacttttatcacctcttaacaagatagataaataaatctgttttatgctgctgtattgtgtttgtcaatatgaagcaaattaatcctttcttgacctgtggtggtggcaggggaataaattttatatatatatacatatatatatgtgtatatatatatatatatatatacatatatatatgtatatatatatatatacatatatatatatatatatgtgtatatatatatatatatatatatatatatatatatctcctctgaaatattgatcttctcttcttctttataacccctgaataacaggagccacaaactcaaacatctaagcagatagcatcaatgagaaaaatgggcccagtttaagacaatagggattagtgggtactgccataaatagacaggatattttccattctccaaccacacctccatatttcttcaccattgagtgtctcagttaccccgatgtccactcttcctttctcatcccatgtctttcaattcaacacagtattcttttgatccagtgcatgcttgtaaattttgctaaaactctacctattattcttttatttttttatttttgaagcaaaatagcatgttctgaggtagcctagaaatgtgtctgacacaaagcattctgtggggttagaagaacaactaataattatggaagtatcaacattaggaatagtggttgctgacatttattagtacttgctatgttctgcttaactatgttgcatgctttagatgatttttttgactttcaaccccaggagttaggtaatcttcttatctccattgttatcactaggaatatggagatgcaaggagacagagagactcactcgggccaaaatccagttgctcaacacttccacctgtcagcctcctgggcgtgacttccccaacgtggggaagatctgatgtgtgttttgtaggtattaccaccttcacctggaaataattcaccactctctaacttagatacttcctggtcatctttcgagactcagctctgggctatcaccagccttagaagccttcccttaccaccctttactggggcaggtgtcccctcctgtgtttcttggctcacaccaccacagacagagcacatacagtattatgagcaacttttggccctgtgctgctcttcctcccgtgactccatccatgactccttcctcccatgactccatccatggctctttccttccatggttccatccatggctccttccttccatgactccatccatggccactccctcccatgactccatccatggccccttccttccatgacccctccctcccatgagtccacccatggctctccttccttccatgactctatccatggttccatccatggctccttccttccatgactccatccatggctccttccttccatggctccatccatggatccttccttccatgactccatccatggctccttccttccatggctccatccatggctccttccttccatgactccatccatgggtccttccttccacggctccatccatggatccttccttccatgactccacccatggcttcttccttccatgactccacccatggctccttccttccatgactccatccatgactccatccatggctccttccttccatgactccatccatggctgcatcctttcatgactctatccatggtcccttccttccatggctccatccatggctccttccttccctggctctcttctttccatgtctcttttccttccataactctcttccttccacgtctctcttcctgccatgactccatccatggccccttccttccatggctccatccttccatgactccagtgccatattttgtaggcaaaaactcatggagagaaaaagaccctctgagaagcatctaccagggatgtacctagagatcgtcaagtgatacctgaacaataggggccacaaactcaactatctaagcaaatagcatcaatgagaaaaatgggcccagtttaagacaatagggattgatgggagctgccataaatagacatgatatttgactataggtggttcacagtttagcctttgcagttagactgctttaaagtggatccttgtgccttatttcactagctatgtgacctgggttaataatgagtctctctgtgtctcagttgccacatccacaaaatgaggaaaataattatgcctaccctaggggggtcctgagtagatataagatggtgttcataaagcccttagcacacagctttgcacctagaaggtgctcattaaattagttcctgttctccatgcttagtataacttctgtatgatgttcagcgttgctttggggcaacactgcaggcaattaaattgtctttctttaattgtcatttcttcctcttattccacaggtatgtattgtacaactactctaaagtggggcacaaaatagacaaagcccctgactttctttttttaattattatcatccttttaacttctgggatacatgtacagaacgtgcaagttcgttacataggtatacacatgccacagtggtttgctgcacccatcaacctgtcatctacattaggtatttgtcctaatgccatccctcctctagccccccaccccttgacaggccccggtgtgtgatgttccccttcctgtgtccatgtgttttcattattcaactcgtatttatgagtgaaaacatgcggtgtttggttttctgttcctgtgttagtttgctgagaatgatggtctacgcaaataaactagaaaatctacaagaaatggataaattcctggacacatacaccctcccaagactaaaccaggaagaagccgaatcccttaatagaccaataacaagttctgaaattgaggcagtaattaatagcctaccaaccaaaaaaaagcccaggaccagacggattcacagtagaattctaccagaggtgcgaagaggagctggtactgttccttctgaaactatttccaaacaatagaaaaagagggactcctccgtaactcattttatggaagcccctgactttctaagcttattggtttcactggtgttgtctgtaatggcagccatgagccccatgtgactgtttaaatttaaatgtaaaaattcagtgcctcactgggactagttacatttcaagtgcttactgaccacacagggccagaggctaccatactggatggcacggatatgtgagtttgctgaagctgccatagtaaaatgccacagactgtttggcttaagcaatagaaacttaattgtctctcagttctggaggccgaagtccaaatccaaggcgttggcatggttggtttgttctgaggctttcctgcttggttggtagatggccgtcttctctctgggttttcacatggtctttctgtgtctgtgtctttgtctttgtctcctcttcttgcaaaggcagcagtcatgttggatgagggcccaccctatgacctcgttttaactcagtcacctctttaaagaccttctttccaaatacacattctgatgtacagggggttaaggcttcaatatatgaatttgggagtggggcaagtatgccattcagcacatcacaacaggatagaaaatttttataattacagatggtggctcattcctgcaactgtagcactttgggaggtcaaggcaggtgaatctcttaagcccaggagtttaagaccagcctgggcaacatagcagaaccatatctctactaaaaatacaaaaattagctgggtgtggtggtatgtgcctgtggtcccagctatttgggaggctgaggagggaggatcacctgagcctggggagatcaagactgtggtgagctgagattgctccactgcactgtaatttatgtgactgagtgagacaccttctcaaaaacaaggaaacaaaaaatgaaaacaaacaaaaaacaccttaaacaaataaatgtccgtgttatttactaatactgaatatatacttaaaaccagcacttcacctacatgtgcattcttctgcctgggaggtgttgatagagtgaccttaggaaaatgtctttgtctgtggttcaaaaatgaattggacttgagtgagaagaggcacacatcttctctccccctccctccccttgcttcttcccatttccatgttccgtcccctattattctctcatactctatttctcctcatatacaggtttttttttttttttttttttttttttttttttttttttttgagttggcgtctcgccctgtcacccaggctggagtacagcggcacatctcggctcactgcaacctctgcctcccaggttcatgccattctcctgcctcagcctcccaagtagctgggactataggcacccactaccatgcctggctaatttttttttttttttttgtatttttagtagagacggggtttcactgtgttagccaggatggtctcaatctcctgacctcaggatccacccgccctggcctcccaaagtgctgggattacaggcgtgagccgccacgcctggcctaccaggtgtttttctaggccctattttagaagaggaagaaaagatttttaccctcaaggaatcttcagtctactggtgtctgagagacctgaacaacctaaccacgatgtattgccaaagctggtgagacagaagcaggggaaaaatgaaacaggatcccttggaagggagatgtcactcctgctctgcggtcgtgggaaaggctgcagagagaaggcatttcctctacacccaaccttgaccttcagcaagtcccttagcctcccgttgagtggcaggcaacatgtaaacagcagctatctcttagagggcaggagttctatgaatgcacttattaatcactgtgaagctgatgaaaacgatcaccataaaactatgacacactccttttcttttccaagaccagtagtgctgaaaggccttcttgtccgaggcttaccatatagacaggtacctcatatcaccatgaatatatgacgactttttaatcaagtgttaatggtctcctacacttcacaaagcaggaatggagggggtcgttgcagctggtaatgaccgtatttgcttttattgtatgattacctttattcaatctctagttccaaaaagggttttagatggcttataataaaggtgcagattcaataaaccatgagattattaaaagaaattacgtggtgagcctagtaatgaaataattggggggtggtaagaaaatattcacagaaatcttaagatttcattttttccaattgattaagaatcttagactaaagctagccactggaactgagcacaaagcttatatctaaggattctgataaaatgcaaagaaaagaagaaagaaaaaaagaaacaaagattatatgtctttatatgtcgagctatattgctttcttctttcaacaataatttatttagcacctactctgttgctggggttttgatagatgctggggagtggagggagaaagatataaatactattaagaccaagtcctttcagatagaagaattatgtatttctgtaaaagagaattgtgtatttttagaaaagaacatggattagtgtgtgtgtatgtgtgtgcgtgtgtaagagtgtgcatctattcaagctttgtttttccccctagatatgggtgtctcaccctgtcttccaggctggagtgcattggcatggtcatagcttactgctgttctgaagttctgggctcaagcaatattcccatctcagcctctagagtggctgcgattattcaagtttatcattgatgattgggaagagccacagtcaatgaacctagagaccagataacttagggccctgttaaggcaagttaaggagtttagcttttactttaaggacaattgggaaccattgaagtggatcaaattttctatttagaaagataactctccctgcagtgtggagaatggattgcggtggaaggagagaggagaggaacatcagttagagggcggttgcaggctgatgggcactttgggtgggaataatggctatgggaatgaagacaactgaatggatccgtgagacacagagcaagataaactatttaacttgtagatcaattgtacatgaagaatgaagttatgagaggaagcaacgtggactcaagtttcattctggtaccttctagttggattcatgtaccatttaatgagatggcagaattagaaaaaagagaaagtattgggtcttagtgagaagatgatgtattaacttgtaggtatgatgtctgagatgtttggaagacacttaggagaagatagatgttaagtaggcagctgagtataagaatctcacactgagaagtgagaggggattggtgatttgggagccttggagtataaacaggttttaagccatgggaattgatggagtcctctaggtagagtttaaagaatgaaaagaaaagaaaatccaagacgtctttggaccccaaacattgagacgtttcccagaggagaaaggatttataagacagtctaagcaccagtagctagagatgtcagaaaatcagcaggaaatagtggtgttatggaagcaaaaggaaaactacgtattacagagcctgtgatggagtggccatagggtcccttgccaatggaagccatggcattggatgatagactcaagaagtactcagagtgagagaagatgagagcccaggacacatctctgggcccttgtgttattttctggtgactgtgaatttccggaagtccccccccccgcaatagctttgatttgacatggagagaagtgtgccttccatgatacactgtgaattactgactaccgttccaggcatcttaactataactttaatcatctgagctctagctcccatcaccattcctgcagtgccccaggactcattaaatcgccaggggtattcgaagacctcccaattaaggacccgttttatgagcatagttgaaatcctggaaattattgcctctttgaggcacaggagtaggtgctggtatctgctaggatgaatgataatgtggaccccggtgatttgctgtccttcatcgtttgatctgctttaatgaccagagagtaattagtccgttgttgtgtgcagctaggtgttacaaatggagttgtaaattcagcgccttggaataaaaagtggctattagtttctcccctgcaattcagtttacagatagttctggggcaaagtgagaagaagcccagtgtgccctttcaggggtgacatggtggtcacgtacatgtgcaaacagatgcgtgtgcacacacatacataggtttgtgttctcaaaactgaaaaaaaaaagaatctctttgatgtaatttctttgtagcatgtttttaaatgaagatattgaagctgatggcatccagggctggggaagtttgaagaagggaacagaaaattttgcaattggatttccagcagtaactgtgtgcaaacacggcccctccctgtatagcagaactctgtgttatcctgagctctggaagttcgtctgcagcatgaagttttttaccttgctggcatcactcaggaccacagagggagcatgcctgctggttaaggatctgtgggactacctgtgttctcagtctggctgtactatttactattggtttcaccttggaaaagacacttaatgcctctaaggcttcatttctccatctattaatgaagatagccgtagaaccagactcattgatttattagaagactcaaatgagaacattcacggaaagagcttgccatgacaccagagatataccaggtgctaaataagttgcttattattctcacatcttcatcacagtaaacaacttggagaatacagacaaaccaggcatcaaccattggtgtttcagagcaagagaataactgacatccagtatcgtttcctaagttgatcaaactcttcctgaccatgtggcgatatatgcagaggcccctcaaaccacagggaaaacaaggtaaagtggccagtgctatgctcatttgacctaggagtaaggaatgaaaaacggtatctgtgttaaagcaattacagatatacgacagagttgcatgtaaaatgcatgtggatttctaggacaaacacatcatatcaaatgcatcttgcccttgcaatacttgattccagttgtgtttcccagaattactggagggttaggtcactctcctctggggacagctgattttctccacaaaactggtgattaggaggactgtggaaatgtgcccacacttcccagtaagcatttcttcttgtgctttattgaagattccactagaaattaagtgctttggaaattgaagttttgaaatcagcacattttcagccaagcctggtggctcacgcctgtaatcccagcactttgggaggccaaggtgggtggatcccgaggtcagcagatcgagaccatcctggctaacacagtgaaaccccgtctctactaaaactacaaaaaaattagccggccatggtggcgggtgcctgtagtcccagctacttgggaggctgaggcaggagaatggcgtgaacccgggaggcagaggttgcagtgagccgagatggcgccactgcactccagcctgggcgacagagggcgaaatcagcaagttttctttattcaggatactcactcggcttaccatgccatcctttcaaaagagttttaattttatttctcctctctgcatcccctcagtatgaatttaggtacaccaagaatttatcaagcttcaaaataatctaaactatttgaaatggaagacacctaagaaagaaaatcgctttagagctgatcagtcactgacctctatatctcatctcaaagattttcttttaattaccctatatctcatgcttctgatatctttaaagattaataaggcatccatatatccaaacaatatagatatatggaatatagaaaataccaatgtctttagagtcaatacttaaaaaatcttgctcttgccgggcacagtggctcatgactgtaatcccagcactttgggaggctgaggtgggcggatcacctgagattgggagtttgagaccagcctggccaacatggagaaactgagaaaccctgtctctacataagatacaaaattagctggatgtggtggcgaatgcctgtaatcccagctacttgggaggctgaggcaggagaatagcttgaacctgagaggcggaggttgtggtgagctgagatagtgccattgcactccagcccgggcaacaagagtgaaactccatctcaaaaaaaaaaaaaaaaaaaaaaaaaaaaaaaaaaaaaaaaaaaattcttgctctttctcatgaatagctgcccaatattctgtaatgtaggttatattagattgcttggggctgccataatacagcattgcagacttggcagcttaagtaacagaagtttattttctcatagttctggaggctggacatccaagattaaggtgtcagcaggattggttccattggttctctctccttggcttgtacgtggccatcttttccctgtgtttttccctgtgtgtgtgactgtgtcctaatctcttcttataagaacactggtcatagtggacaacctataggatgagagaaaatttttgcaatctatccgtctgacaaaggtctaatatccagaatctacaaggaacttaaggaaatttacaagaaaaaaaacaccccatagaaaagtgggcaaaggctatgaacagacacttctcaaaaaaaaaacatacatgcggccaaacatatgagaaaaagctcaacatcagcgatcattagagagatgcaaatcaaaaccacaatgagataccatctcacaccagtcagaatggcgattattaaaaagttaagaaacaacagatgctggtgagcttgtagataaataggaacacttttacactgttagtgggaatgtaaattcattcaaccattgtggaagacagtgtggtgattccttaaaggtttagaaccaaaaataccatttgctgcagcaatcccattactgggtatatagccaaaggaatataaatcattctattataaagatacatgcacgtatatgttaatagaagcactattcagaataccaaaaaaaaaaaaaagtggaatcaacctaaatgcccatcaatgatagactggataaagaaaatgtaatacatgtacaccatggaatactatgcagccataaaaaggactgagatcatgtcctttgcaaggtcatggatgaaactggaagccattaccttagcaaactaaagcaagaacagaaaaccaaacactgcatgctctcacttataagtgggagctgaacaatgagaacagatagacacagagaggggaacaacactcactagagcctgttgggagagggtggggggaagaaagcattagggaaaagaatgaatgcatgctgggcttagtacctaggtgatgaggctgataggtgcagcagcccatcatggcacgcatttacctatgtagtgcacccacacatcctgcacatgtatcccagaacttaaaaaaattaattaaattttaaaaaaagaacactggtcatagtggattagagcctacccttatggattccttttaacttaattaactcgttaaagaccttatctccaaataagggcacattctgaggtttgagggattaagacttcaacgtatgaattttgagggctactatcagcccatgacttaggtgtatgtaatttatttaactatattcccatccatgatctttcaggctaattttacttgttttgtatttcttcacattaaacaatgtcatatcaactaatccaaccataacacttgtgtggctggataaaacagaaatgttttattgtgatgtggaattttaactttgtcttttttgttcaaactaagaatggcttatgtctccccatagggataacatgattttgttttgacagaaatctttaatggaagattattttttttctcagtggcaatctgcagattaatgggataattttaggtgaactgaagagaatggagggctgttctgtttaagctatctttgtgcttatgtagggacagtaatatcatccaataaaaggacatatgcaattatatcagctttgtggtaattatatggatattttcattgttcagtacatttaattatgctttgttaaacagcctgtattagcttttggtggggcaagctttgactggattaatgccaggggcttgtatgttgaatgtttcacacgatgcatctttctagaaggaaagagcaaacaaaaattaagaaaaagggtcatgattacctttcccttatttttccttttcaacaacatttttaatggacagttccagagacaatttcatcctttataaaatccttatattagtcatttgaaagaaaagcaactaatatatggttttggaaccgttaacccaacacagaactctttagagttaatgtgtggcctcctccccatctaccttcgcagtcctccagtctcactctgggaggggcagaatttccattgacagcctgatgcatgctcttctgtatggtcccctttgctgatacaattatccatgtgcatgcttatgctttttaaagggtggcctcatcctccgccttttattcagtaacttgccttttttgcaaggcatggttattgtccacacatgccaattattaaaaatctacttactccttttacatatctgcatagtattccatagtatggatgcgtcactatttgttcagccatccttccactgatgttctttagattaattcttcgttggatttgtgtatttttttcttctgccaaaataagcattgctataagaaacatttggcacgtatttctttcattttggtactttctgttggctaaaattctctgaaatgaaataattagtaaaagctcaccaattttttaatttcaacaaatattaccatgtttttaccccccaccgccccccacacacaaaattggagcaatttgaagtcttcccgacgctataaactacctgaacaacactggatgttagcaatcttttaaaaagtattgagtatacacatggcacattgttgctttaattttcatgttcttgacgactaattatacacaaaatctttcctcttataggaattatttaggtacaatatttgttcattttcaattagtttatctttttcttgttaatctattaattcttcgtatcttaaagctgttcaccttagcttgtgaaacttgtgataaacacatgctgtgatttaccttttgagtttatctacaagatcctagtccacttaaaagtactttgtgatcacttttattaataacttaaggagctatccttcccctattcaacttttataaaaacagcctcttgtaatactttatagttttttgctttatctttaggtgtttaaatttacctggaatttacttttgcaaagctaagtatgaaatctaacatgcattatttttcctgtaaagggtagtcagatggcctaatgacaacattaattccatattccaccctttctgttaactcggatgtgtgcatatactcacacagatcacaatttctgaactctattaactcaggtcaactatttatttgctgttgtgtattaaagagttttgcctactaatatattttagccttggcaggatgctatgagatgacatagtaacgataagaattccttactttaaaagttgggcaggtaacatttggggtcagaagctttttgaactgatgaactagttagatttgatggggggtcggggcggagtgtaagtggcagaaatctgacccaagctgatgcaagcaagaaggaagagtattgactttcagacaggaaaaccaagggttgctctaagcttactgaattcagaagctcaaccaatgtcgtgagcaccggtctcgttcaccatgtcatttagctctcttacagccatgtttagcttggctccgccattatacagcagaaagatgcttactaaccgccccaagtttcatcttattccctgaacagcaccagcaaagcacactgaatcacgtgcccatcactaaacaatccccactgttagaaggaggtgagttcctcactggctagactagctctcgcgcccaccatgacctaggaggtgtaatcaatcctgcaggaaccacccagcttgatagtttatcctcccagagaggaggagagccactaagaaaaaatcaaatgctgttaccagaaagaggggctgaccatttgataggctaaaactagtgaatttcactgttcctgattaatgtgaatcaaattttcatgttagttccgaaaattttatcccactgggatgaaggcaactttttcatcgaaatgtgggccacatttaattcctgcatgtaaatgttggtatccagagaaaaacaaattaagataacaatgagatgcgatctttacaacttgaattggcaaagattaacaagttgctaatagccattttggtactactgtgagtaaaacaaaaaaaatcatatattaatggttggagtgcaaactggaataatctttgaagagctgcttttacgaaaagatatacagcttttatcagcaatgcttttttaatgaattaactccatagcaaaaatattttcaattggtttgaaaatagctacgccaatacacaaaagtatgcttgtgaaagtcttggatgacagcaacaacaagcgttgtttgtaataacgaagtcctaccctgatctaatgcatactagtagtgagctgattataaaattgctgtctagttatgcatttgcctgacatttgaagaaaggacaattataccttttaaattaataccattgtttaaatgaaaagaaaacagctacttaatgaagatttagccctaacatcgctgctatagttaattcttcgcaatgattcaccctagagtggtcaggtcacctctcttgtgctttgattacaccttccatatggattacggatcatatgcaaaacatttaattactgagctacagcattaatcacttggctgaatgtatttcaccttttctccttcctgcaatgtttaagccaagttaactgatagcagtgcgttaaaaacaggtagtactatacagcagtaggagaatgtagcctccagcacagagatcccgggggcaattctggagctatcatttattagctctgttgccctcgggcaaatcacttactagctcaggtgagtctgtatcttcttttgtaacatggtcataataaacacagtttctcatatctagcctgattatcgtgaattgtccacacagtatatataagccctgaagccctggacacaaatgtgtaaacattgttcttatggaactgctgattattattattaatctccattttcttgtttctgtgcgatcaggtttttacccatgcaaagtggttgtctaagactatatagatgtgtagagagaggcagagtaggttatttggaaaaagaaagtggtggagtgaggttttgttgttgttattgttgttaattattttatttcatagggagaaggagggcactctccgtgtaccttcgtaaagaatagtacatactctttattttgacagtgtagggtaaacctgtaagagtcaagaaaataacagatttgatactaccctttagtggctatcttgcatgttaatgtatatcctttcatttctgtctgagttcagcagttagactcagctcgtgggttcctacagctcaatttctaaaatctacgtaagaagtaaaatgctgctaagtttacctgcacttttagtgtacattcagatcagagtcttctcagttatagatgtatagggctgtgtgtgtgtgtgtgtgtgtgtgtgtgtgtgtgtgtgtatttatgtccttaaattaagcgctattggagcatggccctgcatatttgtttctgtattgcctgtggtcatttttgtgctaaaagggaagaattgaggagttgcaacagagaccatgtggtccaaaatatttactatatggctctttgcaggacaaaagaaatgctaactgttgatttaggctacagtttactttaagtcactgttacatcaatgaaaaacttggaaactaaatacatttgtgtgtttgtgtgtgtgtgtgtgtgttctttaaacttttaagctaatccttagtttaaccaaaaagaaagactgggtgtcgtggctcatgcctgtaatcctagcatattgagaggctgaggtgggtggatcacttgaggtcacgagtttgagaccagcctggtcaacatggtgaaaccccatctctactaaaaatatgaaaattagccaggtgtggtggtgggcacctgtaatcccagctacttgggaggctgaggcagaagaatcgcttgaacccgggaggcagaggttgcaagtgagctgaggttgcaccactgcactccagcctgggcgacagattaaaactctatctcaaaaaaaaaaaaaaggattaaggattaaaaaaaattgaaatcatccatggttataatattcttgactgcatcttaacatcattggtttgtttttcaaatattgttaaatgcttactatattccagttatggtgcgaggtactttcccatatgttatttagttttagaatcctctcagccaccacctgaagtagttgctattaaacccattttagaggtgaggaaacagatgttcaggaggatttaaataacttgccacgtttcttgaaacttcccagagccagaattcaaccttagatatgtatgaattcaatctgatgcttgctgggttaagaccattggagacaccctctctcctctgtccttttgacaattccatgggcagaatatcacaggaatggcaaatagagggataaagaatgtatgtgacatgcacccaaagagtctccaggccccttttcatcctttcaatcatgtttctaaggtattttgaactaggcgaggctctcttagttcgaataatagcatgctgttcaatgtggacattaatagtcagaatctggtagtgcagctacagaagaagcaaagaaaaaaatgaaatcctctcattgatttctagtcagagaggtgcagaaaccctaagagtccttatgtgagaataagtgttttctctctgtgtcaatcttaatataactaaatgcagcagatttaatcctttctataatttaataatttgtattaattacacttaatgaaatataaattaattacatttaatgaaatataataaagtttatttaatatattaattacgtgtaatgtaacatatgggattttatttaatatactaaccatttaatgtaatataataaaatttacttaatatatgaattacagttagtgtaatataataaagtttacttaatatattagttacagttaatgtaatataaagtttacttaatatattaattgcagttaatgtaatataataaagttttcttaatatattaattacagttaatgtaatataaagcttacttaatccatatttaataaattgaattccattaatatgtattatgtgggttaacatacatacagtgttgtaacaacaccaggaccttagtttacattaaaatagtgcttatttttatagtattgttattttaataattatttatgttactgttaaataagttgacatatatttatgtccaggcaaggtgactttatagtagctgggttttccaaagtgccatatttatatcccctagaagtatactatgctgagacaggagttcttagctgtagaataaagagagctggttttgtagaacattaattttgctccaagcttttggaggaaaaatgttgtttcctattaaaaggaaacaaatatacaggaaatagacagctaatgtgcatgcagtttttaagagaaagcccgagactgcagtcatcctgtgtgatatgccactggactcttccatctatggctctggagcccctaagggtaaggattagacctcatctgccattagctagcggtacttaagtgggaaattttgcaaagcagtaaattataacactactcaaaagtggtttctatttttgtaatattatgatgtaaagttactgagtttgataatgcaatctacatccctttgttgaaactgtagaatatggccaataaagggttaatgggaaaatcccagaatctgctttctttttaatgtttctaatggtcatcttagcaccagagcctctttgagagttaagagaaagaaattaccagagaaggagagtctgtgtctcctgggagatggatggtttgggggaatacggagtggggatggtgatttttctctgcacagaaatactttcttgaagtcagccctttactgtgcaatgtgggatagaattctaacacctccagtataatggcaggaggaggaatggttaggaacattggagagctatttggcctatgtctctttgttatgaagggcccacagtttacgtttttgactttttcaccaaataaaggcttatagcaagttacccagatatgttggcagaatggcaaggctacattcatcatagaactttaagcttgtgccccactgctgggccatactgcctgtcaggcccaaattaatatcttttataagccccgcaacgatgttgtaaagaatacaattatagcttaggacattgccatctgtggtgggacatttcaaacagaattaagtctagagattatgagtgatgcatcattgtcactcaaactgaaattggtatagcaccttctgttttattcaaaattctaaagggaaattattctgccacaaaaattctcatctgttaagtagcccttaaatgactttttttttttgcctttgcaaaaacaaataaaaccattttatttgtgtgtgagttagaacattgaaatgttgagcctagatttttaaatgtgtcgtgatttttgcttctcttgctcagtcctcttttctacttctttctgccttttttatttctaattttattttattattttttagtcttttattttaagttcagtggtacatatgcaggtttgtaacataggtaaacttgtgtcatgggggttcattgtacagattatttcatcacccaggtattaagcctagtacctacccactagttatttttcttcatcctctccctccttccaccctccaccctcagatagggcccattgtgtgttgtttccctaccttttcttaggaaccagaagccccaggcattggaagtggtcaaggcatttttttctttgacccctgggaaggtcttttcttagtacacaagcaacaagaacttcagacagagagtatatgatgctgcattacaacctgaaccattggagttctgtcaaaagaatattgaagagatcctggtagaaaagaaaatagagtcaagaaaaaagaaagtgcagagtaaaatatagagaagtagagggaaaataatgtaatgctgccaaacctaataagagtactgaaattgttgcctctcacaagccagtgactttctcaagttacaaccaaggtatgggattcaaatgatcccactgacaatccctctggaaagtctccagttgaagcctaccctatcatttctttaagagacccacatagacaagttttctccaggtctgagctggatttccttcgttgattgagcaccagatgaggaattggcgtgattttaagggccacgtgcactatgcgaaaaagagttagctttgaaaacaagacaaatacggggtgagacgagatgcaaatgctcggaggtatctcagcactcaagaacaaatgcatgttcacatctcctgtgttaggcttgctcactgctttgatagccggtggaatcactggcaacgttcacattttttcctcctcctgttttcttacctcctcatgttttagttgaatgcatgtaacttgagtaagattaaaaagtgattctcagaatcggaactttgagcttcctgcaaaaggaatatttaagcatctctgtatccaagagtaccatcttatctcacgggctcactaagtgggagttaggaatcctacagttcccttcaagacctatagggcagtagatttgaaccttacaatcctatattgtatttcatgttgaccaatctgtaagcaggtaaagaactgccatcttactggtgataaagagtttatgatgttaactgagctctcattctagacaacaaagtaatccagtgtcctattcaaacttaattcatagttatcaaacagtcattaagtatctactttgtgcctgatagacatttctttaaccagaatgctttgccactgtatcctcattcatttaaaatagagtatatagaaaccagatttagatactgcctctagttgaaattcctgcatccaggtagggctggctgtttgtcttagagaatatgtccctttatgtcctgtctggataggtggaaggtgagtaggtttaacaagtaacatttgatccaggcatttttacagtaacagtttgttattgctggaatttgaccatctcaattcattttcgtaggtataaactagtcatggatattaaatgtgtgactatattgatatatgaaagcttactgatggcacagttttatcatcagtgcctttattcaaatgagttttaaaagttgattagcaactgcattctcctatgttggcttggacatgaatagtgcaaatatgtcagtctttctattcttccaagatgaccttcagctctctatgtgcatgaattccagttggcctttagccactcctccaagtagaacacatatctatccagttgcctcttgtgtaactctttctggagcttccatagcccctacccaacttgatgtggtcaaaatgagcctcttatctttcccaggtatttgtctgatgcccctgaacctggtcatcgataccaccatttagtcaataacttgtaacagtgatctaggagttggccttgactttttggcttcttttacacttgtttttatcctttttttaacacctccagttatacatgtcttctagtgtttctttcagtgagtcttgtcaattctatttatcaaatatttaccaaatcctcttttccattataccgttactgctgtgtctttgtgcaaaccctcatcatcttttaggctaagatacaataaaataatcttccagaggctcttcctgcttccagtgttcctttctgcacacacgagggtagccttcctagcaatgactgttccattttcttatagaggaattaaatctaaatttcttggcatgacacatgggcccctttatcatcttacctgtgccccctttccctgcctggtcttcagacatcaaccctttccatcagttcacccagtcacatctctgcacctttgcataagctgtttcctatggtttgaatgcctttctcccctgactatcgaacaacctgctatgcatccttggagatccaactcaagcatcatcaccttttgaattctctgaaagatgccctttgcctttagttagaacaagaggcatcctctaccaagtagatgcatagcacaatttattccattctgtcatctagtacgataattatactactagtttctattataatacttgtttgttattttccttctccagtaaacgtattctactttgcattctccaggcctaaaagagttctggaatgcaatgggcattcatgtaagtaatgttaaaagaatgactccatcaattatatttctgtgacattctcaggtaggaagatatctttatgcttataattggaaaaaaaaaaaaaaaacctctagtggcagagaatttgtatttctgttagctctcagtattgggattgtatttctgacaggctggcccaccagctatgcttcatgaaagaccatgagccacagggaagaggtttattcatctcagcattggggtattttgcttttcttcaaggcaaagggatctggagactcctttgcaggctggccatgtcttgtgcaatcccagctgtgtctggagattctagcagggatgcagagtgtggttgggacttcacaggaagtcgacttgcatcagaagcacatagggaaagggaagggaaatagaatgaaggaagaaagctttcagcagccaaggcaacaacttcccccgtctctgtctggctctggggccaaacagactcctgatttctctttatctccttgtctctccacctctattcctctgagttcttttcccatcaccccccattctttctctatatactgtttcgctgactagtcatcagactctaccgacaaatttacctgatcttcccagcctagcccttgagcttaaccattccatccacttctcaattccacatttcttggagagaatctgatttgaccaggtaggggcatgtgtctgacccaggtccctggacaagggaccgatgaaggccaggctgtgagagaagcagtgtctctaagaaaccctgcagcgttagggagaaatgattggtatctctatggtacacgtggtggagatgctggctgcacatcccaagagccatccctagaagatggcttccttcccatcctgtaaaccctgagtcagggatgcccccaagcatgtgagatgttgaccctatttctgcacttggcccaagtcaaatccagtcattgctattgggggtcttgttgcatcctgttgtttcctttgggaggtgacatactgctgacatctgtggagtgaagggatttggggaaagtgtgagtcatcatctctctgatgacattttattctcttattctccaaactctgcccagcttctttcttttttctttctttcttttttttttttcaatggaatctcactttgttgcccaggctggagtgcagtggcgcaatcttggctcactgcaacctccgcctcccggttcaagtgattctcctgtctcagcctcctgagtagttgggattacaggcgtgcgccaccatgcccagctgttttttttgtgtttttagtagagatggggttttaccgtgttgtccaggctggtctcgaactcccaaccttatttgatccacccacctcggcctcccaaagtgctgggattataggcgtaaaccactgtgcccggcccagtttcttatttaggaccctcaaggaagaattgttgtaaggaagatagcatgatcatatagggatatctccaggtgaaactcttccacctttacaagatgtatgctggtataacagagaggaacacccatgattacctatgtacctctccctatgtacccctagtcttctgcccggggaccccaggatgccctgcaacacatggaaataaaatttacctcctgactcttggctctcacagctcttatcctgaatctttgttttctagccctgcctacttatctattttgttttctggtgattagtgaacatggatcaccctccgaggctttttgttggcagggtacatgtctgtctcatttttgtagttctgtagtacaaatcagacagcaagtgctcaattaatccttgaacgaaacaaaagaaaggagtcagttcatgcaataatggatgctgacaaccctagcatcttatcgaaggtatgtatctccactgactcacccccatttcatcacaaggctatttcccacccaacagttgcaaaaatctgtcatctccttgtttcttatctgtctccctcactagaacataagctacatgagggctcttgttttgttaatcctgttgacaaaaaacatagcttctgttatttttatttggttggtctttattgaagaaataaagaccaaccaaataaaaataaacagaggctatttattcagagcttgctatagcaaggagtcagacatcctcacttgcattttgccagaaactcaaaggcaggcagaggagtaggaaaattttatagtagataaataaagggacagcttcagatatggcctggctagaggctgtttgcgtggggaagctgcagatgggctaagtagaaaggggtgttccttgtgatcggttaaggtgcacacttggctttctctgattggtccgaagttggaggtgtggacaaaaattaggaaagctgtcagttacgaatctagtcctgattgtttctgagccagtggatttttgtttggcttcctggaccagttactagagatagtaatctgacttccttgaatcgtgacttgtggatagcaggctggcttcctgtagacaataagctggtttcctgggctggttactgcaaactgtgggtcagatttctctttttctatatggtcttgccagtgtccatttgtgtatgcagtctatccttgatgggagggaaaattaaaaaggaaggaaagaagggagggaaaaggatggggacatcatagtactattatccagtttttattatccagattctatttcgaacactttaatcccatttcgatgtgagggaatagtaattcatcccagagcggacgtgacatctgttttcaggaccctttaatcatatcccgtggtccaaagctataacacagtgaagaggaaaaagactcttttcctgtcagtcgcccaaacgggagccaaaggcttttgaggaggcacttaaagaattttcactttgcaattgtgcagaagctgttgttcaggtaatttaacattgattttagtttaaaaggcaattaagacaaaatgggcagccaccagccacttatgttaaataagcttagatttaaattgctcctcatcaccacctttgttttctatgtctgggctgttctatgctactttagcatgggatggtgtggtgccccaagtggggcaggtggataggcgagggaacccagccagggaaacggttattgaaagagaaagaagttggccaaaaattgttctcagtggtgagatgagttccctttcatactgctgctgggaatatggattcatgtaagcttctagaattctggttccttagatctaaaaacttaaatacggtgcccacttttttgactcatcggtttcacttttaggtatctaccctgagataaggcacagagaaaaatatcataacatcaggaagtgatgttcactgcagtgttatttaacataaagagaaagtgtgtagcattagagtggaatacataaactgaccttgtacattttttgtccttacagcacaaagtgttcatgatacattgcaaagtgcaaaagatgaaggcagcttatacagtaacatcccaattgtgtgcttataatgttttagttctatatgcagtagaaaatgtctgaagtggatagacttccaacaaaatagtacttggagctctctttgggtggtgaaataatgttagcttttctggtgctttttgaaatttcctaaactttccacaataaacactcataggttttataattataaaacacattgaaaacaatgttggttgtaatactattagaagaatattcctgtcagcagtgtgcttgattcctgccatctcaaggatgaggctatatgtgcatgctaagttataaggagatggaatggatattcggttgcaataattctgtttcttgcttaaaggaagtctgctacgcttcaggaatgagggtcattcacctggtctttgtttaaatttgtaaggtgaaccattttgtagacaatgcttggaaaatatgcccaggtgattcatgcatttgtctattagaaaacgtggtcacttaccagcaaccaatatagagctaatgggattcatttagaaatgtaaccacaagtccactataaatcgtatgttctcccatctcaatatgcttcattaagctcacctttcttaatgtaactggattattaggtgtcaggacaaagaaaatcagtaggtcctagtgttctaatcctgcaaactttcaatgtggttgctatgtaattttatttttttaggtggagcttgctttgtgcttttctacaggaaaatattttcaaactggtaaagaagtaatattactgtattgtgaggaatatttcaataggtcattaccataacttctagcagaaaggataatctacgtcgcattttacttcaaggataagattgatttttataaaaatctttagtgcattgaggcttaacgtctttttttccccctatgaagaagcaattagatgctggagttttccagaaatgttaggtgggcataaaccaaaccttgatgcttttctttttgaaggttttatcatccagcgtttgaagagaacaggcagttcccaggtgaaaaaaaatgttattggtacaatgtcagtcatcgacactcacatggccagggacgccacccttttcttatatttacatctgtttgaaaaatagagaaatacaggaaatgacaaagaagaaaataataagcacctataatctcactagcaaatactacccattttgtatgatttcttccaggggtgtgtgtctacaaatatccgtagagacatacacatacactttaaaaaaatagtaaatacacatcttgtacacttaaagcaagacctatagatgtacaggcacaccttggagatactgtaggttcagttacaagccactgcaatacagtaaatatcataatagagggagtcacactattttttgtttcccagcgcatataaaagctgtgcttttgtaccatactgtagtctattaagtgtgcaatagcattgtatctaaaaaacgacgtgcataccttaatttaaaaagactttattgctaaaataaaaatgccaacaatcatctgagcctttaatgagttctaatctttttgctggtggagggtcttgcctcggtgttgatggctttgtactggtcagggtggtagttgtggtagttgctgaaggttggggtgactgtggcaatctcttaaaatgaggaaacagtgaagtttatcacatggattgattcttcctttcatgaaatacttctctgcagcacctgatgctgtttgacagcattttacctaacgtagaacttctttcagaattggagtgaatcctttcaaactttgctactgcttaatcaactaagtgtatgtaatattctacattctttgttgtcattgcaacaaggatcatagtatctttactagatgtagattccatctcaaggaaccactttttctgctgatccataagaagaaactcctcatctgttaaagttttatcacgagattgcagcaatgtagttgcctcttcaggctccacttgtaattctagttctttagctatttcctccacatttccaggttcttcctccactgaagtcttgaacccttcaaaatcattcttgagagttggaatcaacttattccaaactcctgttaatgttgctattttgacctccttccatgaatcttgaatgttcttaatggcatctcaaaagcgaatattttttagaatatttcagtgtactttgcccagaaccatcagaagaatccgtgtttatggcagctataaccttatgagatatatttcctaaataataagactggaaatcaaaattattccttgatccattggctgcaggaacctatattgcattaacaggcacgaacagaacacttatgtccttgtgcttctccatcagagctttccggtgaccagatgtgttgtcaatgagcagtaatatttttaaaggaatccttttttctgaatagtaggtgttaatagtgggcttaaaatattcagcaaaccatgctataaacagatgtcctgtttcatttctagagcataggcagagtagatttagagttattcttaagggccctaggagattcaaaatggtaaatgagccttgctttcaatttaaagttaccagctgtattagcccctaataagagcgtcagcttgtcctttgaagctttaaagccaggtgttgacttctttctatgaaagttatagataccatcttcttccaagagaagactgttttgtctacactgaaaatctgtcatttagtgtagccaccttcgtcagtgatcttagctagattttcagggtaagttgctgcagcttctccatcagcacttgccatttcaccttccacttgcatgttacagatactcctccttgccttcaacctcatgaaccaacctctgctagcttcacactttttttttgtcagttttcccacctctctctgcctccatagaattcaagaggattaaagtcttgatctggattaggctttggcttaagagaatgttgtggctggtttgatcttccatctaaaccactaatactccacaccagcaacaaggctcttttacttattagtagtgtgttcaagggagtagcacttttactttcctttaataactttttcatcacattcacaacttggctagttggtgcaggagcctagcttttagcctgtcccagcttttttttttttttttgagacggagtctctagctgtcacctgggctggagtgcagtggcgtgatctcagcttactgcaacctccgcctcccaggttcaagcgattctcctgcctcagcctcccaagtagctgggattacaggtacctgccactacacccagctaatatatatatatatatatatatatatatatatatatatatattttttttttttttttttgtatttttagtagagacagggtttcaccatgttggcgaggctgttctggaactcctgaccttgtgattcacttgccttggcctcccaaaatgctgggattacaggcgctgtcccagctttaaaagtgtcttcgtcatgaagcttaatcatttctagcttttgatttaaagtgagaggtgtgtggctcttcctttcacctgaacacttagaggctattgtaaggttatttattggtctaatttcaagattgttgtgccttaaggaatgggaaggccaaggagagggagcgagcagggggaatggcctgtcagtggaacagtcagaacacacacaatctttatcaattaagtgtgccatcttatatgggcacagtttttggcaccccaaaacaattataatagtaccatcaaacattgctcatcacagatcacagtaacagatctagcaataatgaaaaggtttgatatattgtgagatttacccaaatgtgatacaaaaacataaagtgagcacttgctactgaaaaaaagtggcaccaatagacttgctcagcacaaggttgccacaaaacttcaatttgtacaaaatgcaatatctgcaaagcatgataaagtgaaagacaataaaatgaggtatgcctgtgtgtgtgtgtgtttgtgtgtaagcgtgtatacaactttaaaagtttcatactgtattagtccgttctaacactgctataaagacatacctgagactgcgtagtttataaagaaaagaagtttaattgactcacagttctggaggcctcaggaaactttcaattatggcggaagaggaagtagacacatcttacatggcggcaggtgagagagagccagaaagatcagggaactgccttataaaaccatcagatctcaggacgctgaggcaggcagatctcttgaggacaggagttaaaggccagcctggccaacatggtgaaaccctgtctctactaaaaatacaaaatttagcccggcatggtggcacacacctgtagtcccagctactcgggaggctgaggcaggaaaatcacttgaatctgggaagcagaagttgcagtgagctgagatcatgccactgtactctaccctgggtgatagaacgagatgctgtctcaaaaaagaaaaagaaaagaaaaccatgaaaccatcagatctcatgggaactcacccactatcatgagaacagcatggaggaaactgcccccatgatccaatcacctcccacctggtttctccccttgacacatgggaattatggcctcttacagaaaaaagttcaccaatcaccagtctaggccaggcacggtggctcatgcctgtaatcccagcactttgggaggccgaggcaggcagatcatttgaggtcaggagcttgagaccagcctgaccaacatggtgaaaccccatctctactaaaaatacaaaaaattagttgggcatggtggcgggtacctatgatctcagctactcgggaggctgaggcacaagaattgcttaaacccaggggcagaggttgcagtgagctgagatcgtgccactgccctccaggctgggagacagagcaagactccacctcgaaaaaaaaaaaaaaaaaatcactggtctagaaaaatgggactgaaattcacaatagtgtcatctctaggaaaagaggaaggagactagtttttacctgagtttgagagctccttttgttcttttaagagaacacttatgtactggctttatgcttttaaaagtgatacacatgtacacacatataacatatagagtatatatacatacacacttttcacttaaaacaagttatatgtatacatgttatatgcatgtaaagggccagagagtaaacattttagacttcctgggccacttggtctctcacagacactaaactccgcatttgcagatgaaggcagtcgtagcaacccataaacaaatgggcatagctatgtttcaataaaacctcattcatggatgctgaaatttgaatttcctacattttttacacatcacgaaatattattcttcttttgacttttaaaaactatttaaagtatcaaaaccatttttaactagcaggctgtacagaaacagagaatggctgagtttgattcttgggctgtagttggctatcttctgttttggactgttcccagtacattcacaaatatttatatatctacggaaaacctataatattatattagtgcattctctttcagaaatggtgtcataagtgtagaagtcatttaaaacttgtatttttatctcagcaatttatttttgctgagaaatatttgtatatatatttgtaccttatagtgtgtatttttatttctgttcctacatattcatgtctatatagcaatggaggtattcatatgtggctttatttgattcttttcactgctatatggtattccatcatatgatatgccatatttttaatgctagatgggtatttagtctgttgcctccccccacaaccccatcctgtatcacaagcaatagcaattatatccaaacatatccacaaatgtatcttgtgcatgttttttaggacagacattagaagtagagctgtttgataatagggtatgcacattttccattttaataggtactagtaaatcagcttcccgagagacaatatcagtttacagtgctcatgggagactctactgccattcttggtttgggaggttgcatcccttcctgttttacttatggggtgggagcaagaaaacaaccttctctctgtatcatcttgccttgtagttacagctgtaaatgtgggccttcatgtccctttgggtggctgcagacatggttttaactgtttgctgtgccccttgcacatgagaatagcaatttatatcaataaccaggtctggcaacatctgccaaggttgtcacgctctgtgattaaatggccacatgtgctgagaacacgaggacaatggggttgtaattagggcttgctgtctctccatcggccacccgcaccatgcgtcccttcctataaccttgcttttgtgaactgatttgtgaatcaaattattccactgggcatgccagtgtgtgctgggttaataataatactctatatttgtgaatctctgtaattgtacagggttctggataagcgaaagtctaaacccctttttgccattttacctggtgctgttggaaaatgtgtcaggggatcatacaagataacattagaagttaactttaaaaatagtagggagtggagcatgttcttcatggcatcattattgtgaaataaggttttactttatggttatctcagcatccgttaaatgccactgaccctgtaagaaaggcaggcagagagaacacaaatagaattttgttaactctgcaaggagaaagttaaacactgtgttaatatcatattaaaaacactcttaatgcacagaagaaaaaaaaatccctcctcgttttgttcctggtatgacaaagatggatgatggttacataaggaattggcatgttaaaaaaagacacacttgaaatattgcctctagatatgaagttgtaacgaatgtgaaaatatttgaaagatttattagcattttaatatttgcttaccaatgcataaaatcctaatcagttgtatacaagttgtatactttaactcaaataaagtatccaagaaggacacaggcaggaagccaatgaatatttcactcattgttgatcaaatataggagggatatatgtatattaaattttatttcccatttagatccttcctgtttaaataagtgcttgaggtagcaaagccatcttagtgcacacagcttgcagttctaactgtgaagagaaaggaaaaagaacaaattagtttttctacatccaagagtcatttccccagccaattaattttttggtccctaccaaaatcagcacttaagctgaagatagctagaacctgtgtaactcattcctattaacaacagcaacaaaaaaagtgaaatagatctatgaggacttcttgggaaaataacaggaaaattactttgatgatattattattcaaggtacacatatttaaaaggtgatctctaaatttcaacagagacgacagttgtttttctcctaaaagcaggctgaaacctcagcgcattctcatttagtacgtaacgtggaaaaagagttgagatcctaaagcttcgctcctaaataaagtgcagctgcttctcggagatgaaataggatgaaagcctagctgtttggggcgggaggcgagattgggggcgcggtgctggggtcttcgatgttttaccagtatttctaggtgaagcagcatattggaagtcataaatactgtcccgtggacattctgaataatgcaggagtagcgtaagtaattgggagtgcttatatccgcctttagacatttgattgctcgtgagttaaaattggttgtcaagtgcggactcagggaaccgtgcaaggtgccctattctgtcatgtggtacatatttaatgcctgaaagaacaagggaagggacacgtgcgggcgagagagggcgagcggcgagataccgcagccagctcggagctttgcaagtgcctccgacccgtaggggcgggacccacgcagccccagtatccactgccttcccccagctgcaagagtttgcaaaaacattgggcgtctcatttggcgagcgttttggcgcggacagaggccgaggccggccggggaagccggacccgggccctggcgccgccgtggcctccctttgtgcgcgcccgggtgttgattgcctccttgcacgggctgctcgctctcgcgcccgcgcgctcggggcgttctgcacctgctggcggtcgtgccaggcagcccgggcgagcgaaggcgcgcggcgcgcacgacagatgactggagtcatttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggagtgtgcaaattgacatttttggctgcctgtggcagaggagcagccgtcagccgctgtccaacgttagcgcagacacggtggcggcgtgtgcgcctccggggctgctgattagaataggggacttggccgtggatggaatccgggaaacccaaaccggagatggaaggatgaggctgcgtttgcagcgcgtgaatgggacgcggtatgtaagccgagctccagctccggggacctcggagactgtgctcagggctcgccctgggtgccccgtggtgggggtggtctggacacttggagagggctagggggcgtttagagggattggggagcccggagatgcatcgattttctttacccactggaagttagtgggcaacttccttgccaatgctcattggctccgtttaactttattcccagagatgaataagcgtttattaagaaccgatgtaaaagtcccaataggctagccatggttttgcaagagatgcgcggctctggaaatgagaggtttatgaaatgaatggccagatgggttgtgcatttgcgaagttggcatgctcacgttgcaagggagcatgtgtgtgcaaatgtgagcatatgcgctgcatatctgtgtaaacatgtccaccatgctcgttgcgctggtgtactcttcatcttctctgcctgtttcccatggaagagagattaaattgacaatactgaacacgcttcgacttgagaaataagctctgtaccattttatgacatggaataagagttgccttcttctgagatcaaatgggagaaatgtgccttgccttctcaagtgatggaatgaactgttatgcatttatagaatatattatatacagagtgtcgaatgtgacatccatcagtctacaatgatcacctagcctctcaagcacagctcatccctctagcccttattttcagattatggggaaattgggggttttattatttcttttgacaaaagagctgcgttttccaccttcctacttaagagggctccaagcagaattgtgaatccaaaagttttgttggcagtgtcaccttagtaaaacgttatgaaattatttgctaaaagagtcactttctgagtgtcttcacgtagaagaatttactcattgttgacatggtttcaattttggttacacagaaatgaatgcggtttattgctgaagcaggcaaaaatgattgtgtaatcctctctttagtagggtagctgggtagtaaattgtttggcttaaaatggggacatctttctccactgtgttccctattttttgatttaaatgtgtgctggaaaatccaaagagtgtgagtaaaagggtgtttgtggcatggagtaacttgcctttgtggtttgctatgactaagtttgaagagggttgtttgttaagtaagtgaatgcaagtcaatcagcaacagctgcttgccactcaggctcacaggaatccaggcttttcatttaaaaagcaagattttccaagtcttatctgcccacacgcttcccacacgtgtgatgcctcccctctattagaatactcagaggttatgaagagggaattgttaatctgaggaatgaggtagggggacatgtagaaggagctcctccctccctctcttacccctcttctcttctctctcttggtctccctctgggtatttcttcctccttatcccattttttttcatctacgtgtatttctttccatctttctgtctttactgttttacctggtgcacagaaaccttttaggtatctttgctacactttaacatatgttttgcacgctggaggatcaccagagcctgtttttctttctttctttcaggaattctccgctcacctgcaagaattatttagtatcaggcaattccactgtacagcagtcttataaaaagtgaatattcaaacttttttatcatttctttttaaccaagcaactagactctttgaaaacacttttactatgtaaaaagagcagaatcttttctgttaccccaaattgagggtttatacgaaagtactttctgtctcatgactttattggactaagcttatttttacatttgtctcttaaaatcttatccttcaaacttctgtttttcctatcacttgtcttaattttagagtctggattcattttaatctgtatttactcagacttggtagaaataactatcagtgctgacttatgggccaggtaattgaagtacaacaaaaatagtttttcttttttgtatgatattgtgttcctttttgctcttaaaaaggaccagctaattatttttctttttttttttcctctctctactaggagtatgatacaaaagttgaaggagatctcagtaaaaggctttttttttttttttttttttttttggcattgattgccttcctataaactatagttgcaatatttggaaaatatattgtcatattttatgacactaattggtgtatatgacttttgttttgagaatccaggtacacactcctcattgttgtctttgatttgattatagacaacctgcttgaatgggccaatcttgagctaaacaaatattacaacatctagtgaagaacaaacttggtcttgttttctgtctaaatttataatttttatattagattttgagcacagttgtaatctggtgaaatgaaaagtcatctaaaagaggaagaagatatctgaactaataataaaatgattattattaattaaacttagttgtgtttagcttttagcttttattttaaaaacttcacgtgtcttagtctcaaagttatcaaagggagttggcgtaagttcttggaaagtaattctgttgggattaaaagtcctctctatgagacttcactctccatcttgtgttgattttctgacgaacataaaaagaaatgaggaaaaagcttgaacccttaattttattatttttttttttggcattttagactttactttgttatggatccaaaaactttggagtgtgttaaaatatcaaatctttgtttgcatttatgggtatgcgtttttgctctttttgttttctttcattttcatgcagggttgtgtgtttgtgtgtattatgagcagtagtcaacaggagcaaatgagaagaattttacaattatgaattctcatgcataatttgattttaattaaatcatagataatcagaatagcagtctcaaggatttaggatccctgctgaaccccctcttcttgcacggcaccaagagaaagataaaacgcctttaaaagtcagcatttaatatacagtgtttggtttggaaaccatcgcatattaaattattcagcaactataatgtcccaaacagttttcagggtgtgtttttattaagctaaataaagtttctatgaaaagttgtggggtttcagtaagttgtggggtttctgtgtgtgtgtgtgtgtgtgtgtgtgtgtgtgtgtgtacccaaaaggccgaaacagcttatgtcagctacagcaactcgtttttgattcagcaaaactaggttatgaattcaagcaattaaaaatgacagaaagcccaatttcactgcctagattaatatgcttccaatttttcctgctccataaaaatttcaaagtgttctttctgttgaggtgcttgcataacctatagggtattgggagggtctccatttcttgtttgcttatgatgtctgaatactttgatgtagcaaatgtaaataggatcagttggatatttgtaacataattttgtgcttgcaagttctcctgaaattattttggttgggtttaaaagaaaagagctgtggttagtttctaagcatttaccgatagtgaagaatctgtcggcaagctccaatgtcatgaaggccaggaaagacttttcaagaaaagatacaattatagtagaactagtgttttcagcttccaaagatggcagtgatatatgtaaaaaaaaaaaaaaaaaaaaaaaaaaaatatatatatatatatatatatatatatatatatatatatatatatatatatataaaatattatgcagtgatgggcatgtttattactttttctctattcctaaagtaatgtctggaattctagattcatgtttatctaatgagccaaatctctccctgttatttaaaatggtcctttttccttacacactaattagtagtcaaaaccagccgctttaatgatctgtagtttttggtttgttcgttaagttttctaacctggtttgaattaacttgttcacacaaagagtgtacacagacacagatatacactcaaaaagctcatctcccagcaccatttactccacgctttcaatccaatacagaaagcaacaaccaaacaaatcaaggtgcactatttgcccaatgtttgttttacagagaagacccctaaagggctgtatatgaggaaggcctctgccagcccttcctttgctcttcatggtaattctgcatctgcatttgccacagtactgtggatgtatttctttgttgtttagttgtagtctctagttgtgaggaaatcagttgttgtctgcaaagaagatgtaagtactagttggatttattgtggttagctgaatgtgtaagtacaggtcttccatttgtattaaaatgatgaggatgaggatgtgataacctgtcaacagaaacagcagtaacaatacaatgccgatttcttcccgggcacttactgactccctctgtgcatcagacattggacgaggagctcctgtgtattttctctgttcttacaactctgcaaggtaggtattaccatgcctaatttagagatggagaaacaattttcaagactttttataattagaaaaagtgattagactgcaaatttttctgattccaatatgctaagataccattgaagtttattaatctgagtttagaatttagcatttagaatctgtttacacataatgggtacttaagagatacactacgttagggtttctcaaacaggatcaatttcctcccctaacccataataatatttaacaacattttgaagacagtttttgtgtctttgcgagaggatgactccctcctgcaaaacaaaaacaaattacctggccccaaaccaacagtgccacagctgagtaattataccctaggtaatatcagtgatagtctaatataaacatggtctgatttttcaagagagggtagaaggtatgtgtacttcaattattaaacatttaaaatctctggttggatactgtgactaggatcatgatgcaaaatcagacggtccttattcccttacagtctgacactaaaattgttacagctgcttccttggaacatctttctttataaatatggcatgggtcgttgtgatttaaagtgccctatttttttccaatttacttactctttagtacgagaagtgctggaaaatgaaatttctttccttggtactcttgtcactagaagagaaatgtaacgtcactaaatgaataatggaagagcaattctaacaaccttcccatatggtccttcttttccctcagtattcaaatggcattattttcctcttatctttaaaggtttggcacataggtttattggtttatttgtttatataatattttatatttgccgagcactcttgcaaatgctttaaaatattaattcattgaatctttaagataagcctaggagattgttattgtttttatctactttttacaaagagggaacagacatccagagaagttgagtaatctgtatgagatcacacagcttctaagtggcagagctggggtttaaactccaaagtctgtgttcctagccattttctcatgtactttagtaatttgagcttctaaatgtacagaagcctaagcgttgaggcaccatcttcacccgagttttgaaacaaaagacgtttttagtctcattttggagtgcttgatgaggaaaacggacttacctgtttttgaaagagcatgagtgataatgctcacagctttatatgttgctatttaaatactcctgcagatgcacttcacctgggtcaggaggtcttgtgaattctctctaccatgaccacctccaacaacagcaaaaaagccaccaaagggaaacactaatgtacaggagggcacaatttgcaggatgagtgatctccattttatcccctacttaattgtcatgttggaaaaatagagagaaattctgcaactggatctcctaaggtgtcttcaagaaacttaagtctttgctttctgatgctcttaaaatgttctagagagccccatgtggtccatgccaggtgggtgatggtggatgtgagtacgttgactcccagcttgatctcagctaatgccaggctgtttgttgttccacatttaggccacgggaatgaccatgcctatctcagtctcagttgggtttttagtgaatagcaaatgctatgaaaagaaaaacaatttaagtatatttttaaatagaaatgccaatttgacacattttattctgctttagaagggaaaaaaagatcttgcaagtacgcaattaaatacataccagaatatccagaaaaccaagacagaagtagagagcgtcaatgaacttcagttgaataaatgagtacatggatggaacattttgtatttttcaaaatttcttgtcaagaatatgtatgggtttgtacttgaaaatgtctcacatctcgaatacaagccaccgtggtgggaaatacaggtctgacaggcgtccatttcataccagctgtcctcagcttaccaatctaaatttgtacgttacttaagtgttaggcataggtatctgcttactatttattgccctgcagaaagctcagagatgattaagcacagcttacaagtatggactgcattttacctgaggcaggacacagatttttttatacaagaaagaaagggtcacccatgaacagctcgtatctggtcatggagcaatattaaagtctcaaaaagggctgttgagctacctcctcccagcctggagacagtttaggaactgggctggaagtggaatccattactgttctttatatttcaggcccaataaactcacgtttgaacaaagagagcgaagagtgaatcccattgcagaactgtcaaaagactgatgttggatccattactgtcaaatgtccttttttaatacagttcattaaattggcttttgtggaatacctatttcatctaagtgttggttcaggaaatggtttaaaatgaaaccagaatttgttgttcagtgggaaaataaatgagatgaacccacataaccaagactacccagtaaagttctgtagatactatctattagtatgcagtactaaaatttaaattatacgtgtatatatagttatatctatagttaagctatagatatgtaacttatgtatagactagaagctacatagtctatagtctatttatatgtacatataaactatatatagatatatagttaaactatatatatagtttaattgatgaaagaaagaatgggaagttggatttaaaatagccattttaattccatatccagaagtatatggaatacttccgcatcttaaggtgagcctccttttagaaataaagataactagtgataaaccttgtatgccattaaaaagagtgtacccaacactcagtgaatttctgcccagtcttgattgtgaaattttcttaggaatctaaacatatagaagttacatcaatgttataagtggttcaggattcacattctgctgctgacagagaaagaaacctgattttgttgtaatgtactagctaattgttcagtatatagaattgcacatcattatccttcttattgatagtgtctattgagtgcctgcaataagctagacactgtactaattcccagatgtgcattattggcctgaatatttccagcagccctatgaggcagatgtgattgttatacccagggttcatgagggaaggctgaaacttgggatggtttttcaagggttaccaacagctagtgactaaaagggctgctaatcaaatttgaagctttgaggcttcgaagtccctttccccgtttttttggcccaaagctatatcaatcattgttctaacattggtgaaaaatgaatctgatgtagatgaagagatttatgtagctataggaagttcctataactctcctattaggattaaccttcttatcatcttggcaaattatgcaagtggctggatattttgggtagatgggtggatgggtagatgaatggatagatgagtagacatatagactgagtagtaatggagaagacaaattggcaaaggacatgaatataggttttggaaaaataaacataaatagcaagtatatgaaagtgtgtgtgtgtgtgcgggcgtgtgaaagtttcccttgtatatgtgaaagttttatatattgtattggaaaataatttgttgatgaaacaggcattttatatactgttagaatgtggaatagtaccttcttctgtagaggactatttgggaattcttattttgaaaaagtaggctgggcacgatggcccacgcctgtaatccaacactttgggaggccaaggaaggaggatcatgaggtcaggagttcaagaccagcctggccaacatagtggaacctcgtctctactaaaaatacaaaaatttgccaggcttggtggcaggtgcctgttagtcccagctattcaggaggctgaggcaggagaatcgctt[135 bp omitted]cctttctgcctctggaatctgtgtgatcgctgaagtttgtgaagatgcagcttggttcactgccgcattgtgaacagtcagaaggaaactggagcggaggaaatacctaagtagggtgattggaggtcaaggacccttgtaggaatgaagtggatttgcctggatgtaaaactacatctaagatgttatgagtgaggaagagcccaaaactcagaaatctgtttgaaaaactttgttagaaagcaaacatacacatgcaattgttttacatagagggcaatactgcaaaagataatgaagggactataaacagtgattatctttgttgtagctgtgcagtatgactaagagaggggcagggaagagatgaagcttttgcttttaagattacacctttattctttgtgattttcagcaaagatgccctatttggataattaaaaaatatttaagagaaaagcctccattttgcaaacaacctgtgatcactttacccctgagctgatacaggtcagcttagataccaacataggtattctgtgttggacataggcaacctaaattgcttggaaaatatatttgagccttagaaaagataaaactgaaaatcattggattcacagttatgttttggttgaggtttggggtcagtatgctctttggaatggggtggtggggtgttggaatttcctaaaaatattaaatatgtgttaacagtaatggtttgaccacagaagaaaatcaaatttccctgttgctgtacacacttgtcattcatcgccggtactgcaaaatcatgatccttatcctcccagctgtgtgtgtttgtcagggaccgtaggctgctaaaagttgtatacagtactattattttttttattcatctgtgggtcatttcatcttcctgtgcaagccacatgaatagctgtgtatgaaaattgtattttgtgccgaatttcccactgtgaaagatgtttactatatatttatgaaaacactgcagtaacaaaaccctttatatagcctttcaatttgctgtaagggcagataaaatatttttatctcaaactgaacttcataccttgggagattcagctggcctgactcagaataataaaacacttcagagaaaggcaggtgctgttcagattgcttcagaaacctgtgcacttcactcggcagatttcacttcctttaaacacgccaactgaatatacgaaagctagaaataatcagtataaactatgcaacgttaagtacaagaaatcatctttttttattaaatagtttcttaatacatctacagtagcatcagcgtgatttttaatgagtgatattttcctgtataccagaagatacagagagaaggttggcgatcattccagtgtattgaaaactttcattcctcatctgcatttaggctttggcaatgttcttaattgaaatttttacagagataaatgtagcatatgcagttgtaagaaaatatagatagatctcttgtacactattctctaatggtaatattttaccaaactgtagtatcacatcgtatcgaggatactggcatggctgcaatccactgaccttatttgaatttccctaaggttacttgcacgtatttgtgtgtatatatattgttctgtacaacttcatcgtgtgtaggtttctgtatccaccgccacaggtaaggtactgagcagttccatcctgaggttccatttgtataaccacagctatctctcgcgaccacctgcccctgttcttaacccctgtcgatcatgaatctgccttccatttgtaaaactttgttatttcaaaaatggtatataagtgagatcacagagtgcttagagttttgggatgggcttattgactcatcattccctggagttgtacctacattgttacatcagtaattttgcatggtatatatatgtaccacagcttaaccattcacctgttgaaggatatctgggttggctttgaccatcacacataaagctgtcttgaacatttgtggacaggtttttgcgtgaccgtgagtttcacttctctggcataaatgcccaggaatgggccttggagatctttgatttatgcatattatggaacacatcaatatgttgcacccattggaagtcaatgccagttgcgtacaaactgatacaaggaaaaaagaaaattgtacccacgtcttaatgtttatttttacataaacacggcactaaatgcagagaatagccagcatttatgtagcatccaccatatgccaggctgtattctaagcctgttatgtatgctaactcatttgtcctcagagcagccttatgaagtatgtactactgttcttacttatggaggaaacaccaagcacaaaatggttaagtaacttgcccaagattatacagtcatcaccacttagaggtagtcggtctggctggagaaccccgcattttaaccactaatcaatgtccccgctttcttttgtttgtttatttatttatttattttgagatgaactttcactctttcacccatgcgggagtgaagtggtggaatctcggctcattgcaacttctgcctcccggattcaagcgattcttttgccgcagcctcctgaattgctgggattataggtgcccgccaccatgcctggctaatttttgtattcttagtagagatggggtttcaccatgttttccaggctggtctcgaactcctgacctcaggtgatccaccgccccccgcccccgccttggcctccctaagtgctaatattacaggcttgagcttccgcgcctggcagacagccatctataagatgatgtccccactttcgtagatcggttggtcataacttgtgggttggctgagacagtaatattcatttagagtaaacatctattgatatcaccctgaaaagaaataataaatgaaactgggtatatagaataatcagctagctgacttcatcagcccttagctcacagctctgccttaaagcttgctttatttggccgtttcagacagatggatgcctcttatggcttttggatctccaagacgtagatttcacaaccctcccttggttacacactgtaatatttaacagctctcaatagcagtatgttctgcttttttggtgtggcccaaatctctcctatggcaaactcaacacccctcactccttcttcccacctattgaagacgtggaattgttggttgtccattgtattcacaacataaaggtatctgtttgtaacagaatattgtttggctgctttacattaatccttgagcttttcgttcctccaaaggcattttatatttccaacaggcttataaagtatttaatatttttatatgcgtcagtgtaaagccatctgttgcagtgacaggacaaaatgtggaagacaagaacaagcgtatgtttatggaaagattccatgaaatgttaacaagaaagatatgtgctactctggggtgtcttgtagaaaacggtcaggggaatttggaaaggcatggcttacagcattggtatttgtaaattagtgtttataaaaggcatgtgcactttttttttctattgtcctgcaaatttagactagattgttgacataaatggtgacagtgaccactctgaaaggaaatggtggtgtgacctaatatttggaacttccttcatttgttgttcttcattcacaggcttcaactttttccttttcatttgaacaagtggattgggaacctgctttgcggcaggcgtttgtgttgctggaatagctagattgtgtttctaaacagctagaactgtttctcagtgccttacttttaatagccgtgttgtggtcttgctcatacagaaacaatcagacgggaatcaattttgcctgcccacttgaacgtatcagtttaggcacagttatccaaagctgttgctgcattacattgcccctcgtcgaactgggctcagaaaatcaaagcaagttgccccaagcgaagacaccaatgctcttggggaaacacatcacagctaaattacagcgagtattggccgggcacggtgtctcatgcctgtaatcccagcactgtgggaggccagggtgggtggatcgcttgaggtcaggagttcgagaccagcctggccaacatggtgaaacgtcatctctactaaaaacacaaaaattggcctggtgtgatggcgggtgcctgtaatcccagctactcgggaggctgaggcaggagagtcgcttgaacccaggaggtggagattgtggtgagccgagactacgccattgcactccagcctgggcaacaagagagaaactccgtcttcggaaaaaaagacaaaaagaaaatgcactaagtatagtatctgccaagtactacgagaggcactgtgtcttggttggcttatatgaggctctcaaacctcttaggtagcataagaagtcattgtctccattttacagatgagggagcaattttagagaaggtaattaaccaaatattacattgctaacatggagtggactgggaacttggcaacaggccgactaaacccacaagcagcttgcttaaccactgtgttttgtaactgaggctggagaaagaggaggagcttgtgaggtgccttccagaccagctcttctcaggtgggcattagctgggatgtgtgggtcaaagatgcagtatgttgttgagatgtgacattgacatggagcttgatgccctccacagactttctctaaaagttcttcatttctcagctacttttcccactctgtagatagtcacttctcaaggcccagagagcacttggagaaagaagttggtgtgaactctagaagaacagctcttcaaaatgccgcaatggagcaaggacatgtggaataacctccagtataaatcctttacaccgatttttgaagtttttaaaaaaaaaaaaaaaacagagttttgctcttgtcacccaggctggactgcagtggcgcgatcttggcttactgcaacctctgcctcccaggttcaagtgattgtcctgcctcagcctcctgagtagctgagattacaggcagataccaccatgcctggctaatttttgtatttttagtagagacagggtttcaccatattagccaggctgacctcgaactcctgacctcaagtgatccacccatctcagcctcccaaagtgtaggtattacaggcgtgagtcaccactcccggccctattttatattcacaagtgtgagaaagtgcctaaaagcattcagaggttttcaatcatatttataaataaattaatcactgttacccatgtcaaaagatgacaattccaggccaggcacagtggttcatgcctgtaatcccaacactttgggaggctgaggcgggtggatcgcctaaggtcaagagtttgagaccagccttgccagcatgatgaaaccccgtctctacttaaaatgttataaaaaatagccgggcatggtggtacgtgcctgtagtcccagctacctggaaggctgaggcacgagaatcactactacctgggaggtggaggttgcagtgagccaagattgtgccactgcgctcaagcctgggtgacagagaggaactccgtctcaaaacaaaaaaaaaaaaaaggatgacaattccagatagctattcctaggttgataaaattactgagatagtagaatttagagagacttatgagcagaaatatatattgacagaagagcaaaatatcattgtatttcgttaatagaggaacaataatcaggctatctgaaagagaagacagaccagttagcttctaaatgctgttcatttatttcagtcagccttctcagaaggatattggggcttggttcagcaatcaggcccttttagacccatagattttgcctgcaggtgttcctctccaacgattagattgtgatgataggctataaacttcatgaagacagagaacaggtgagcaatatacaattagttcctagcacaatgtctgcccatattaaggacttcgataagggtttctaaagaatgtgtgatcacattggattgtcccagagtatttacaatgtattaagtcctggaaaatctaaataataattatatctataataattggataatgtttcagagtcctattgaggaaagatagtgttattcccacctgctagttcttctcctgaagccaagatatgcatggtaaaagccatggcacagttagtatctgatccctcaactaaaatactgacaccaccttctataggcttatacggcaagtagcagtatgccttggagccttctcctccaatacaccccattggcaaaaagcgacttatggttaatgcaacagtgaaaataaattattaccattctatgattgtgtgacaggttagtaattaacttatgtcaccagttggcttcgcacaactgtgtttattcagctccgtggagcacttttcagggaaaaagaaattatcagccaggcagcctttgtttactgtggaagctggatgctggtggactgcatctcctcctattgactaggaaataagttggttgttaggacatgattttccattcttcaaaatgatatggtgatgcaaggaatttgaaagctacactggaattagaaaagcataaagaaattgccttttatgcactaatcgagccattatgcctgtttcctttggggtatttttttactgtatagacaccacaaacagccatgtgtaaaaaaaaaaggtatgaaaaatcttaattaaaataaaaactgtagtatgtgtttttatcccattgtaggttaagtgggtatcacacagcctagggacaatggtattagatttgtaataagcacaagtaaagcttttcattttgattggattgggtgtatttttcatcagcatctcccgtgtgagccatgattccaagacagagtcttgtaatcttctgcagtgggaatgattcagcttaaaaatcagtagggcatgaggtatttcaagttctcattattgtaatgtgtcaacatcacttcagtgaccccagagtcctatgttggctggttttccccctgatttattgtgcaatctcgtagggcaaactataatttcacttggaatcagaaagtctccatttatggtttgtgtcccagtctccagtcattagggcattcgcgggtaatcgatacctcctcttgttgctaacagctgaatgaagttgtcacctgcttagattacaaaggagtcgggtaaaaggatgtggtaagggtgagtacattgaacaagttctgttttgagaagggctttctctgatgtttacctgccgcctcgtgaagggctttcagcattttttgggacctcctttctagaaacccttatcactgaattagcacaatgttttatttcttcttttgtgaaccgggtgtgaatgatgtcatttcctttggttaaaaaacaagttgaaggagccattcttgaaagtctgcatgctgacacattttctagaaacctttgagtcacgccaactctttttaaatacctggtcatcatgctacaattaaaagaatggtatcttctattttttcctaattggcaaaatacctaggagcttattgaggcctttagcaagaagaccatcatctgtgttcaacacaccatgcttcaaggtatacacattctattttgctgcacatggacatggatgcacgtgtgcacatacacacacacacactcagagcttctcactagaggatattcactgaccatttatatgatattgttaagtcacacaaagcacagtgactccaaattgcagctccaacacctagtacttggccaagggtgagaaggtctacacagatcaacttttgcagaaatatgattaagtcatctcaggaatgttccataatattctgaacacaatagagtcccttccctcaagaaaattaatatccagccatggaaaagagccaaggtgaagaggcaattgaagtacatggactgtaactacagaggcttaagaatggcaagaagaggcattgaactcagggtcttagaaaacttggacactgacatcaacacttgacaacatcttgactgcatgtcaagatgttgttattctcctcacaaagattataaaccaactgtgatatgtgtgcaggagaaaaatcatcgtgttttaaagttgaccttgtccattaagatcattgtcttttatctcagcccttggggagtagtttttttttttttttttttttttttaatgctgagacatcctctgtcccttgttaagttttgggttggtgttgctggaccagccatgttcctgtcttttcttcctatccttcctggcagagccccttcctcccagagctacttcagcagggtaggatggtctcactgcccatgggagtctgcccctggaccctatcctgcttgatgagttcagaggtctttctgctgagcctctttgtcttgccagttaaacattctttttttttttttttttttttatttcacttgaagttttagggtacatgtgcacaacgtgcaggtttgttacatatgtatacatgtgccatgttggtgtgctgcacccatcaactcttcatttagcattaggtatatctccaaatgctatccctcccccctccccccaccccacaacagtccccggtgtgtgatgttccccttcctgtgtccatgtgttctcactgttcaattcccacctatgagtgagaacatgtggtgtttgtttttttgtccttgcgatagtttgctaagaatgatggtttccagcttcgtccatgtccctacaaaggacatgaactcaccatttttatggctgcatagtactccatggtgtatatgtgccacattttcttaatccagtctatcattgttggacatttgggttggttccaagtctttgctattgtgaatagtgccacaataaacatacgtgtgcatgcatgtgtctttatagcagcatgatttagaatccaaacattcttatagacaagggctccttctcctgacgtttctgatctcattctaaaacattcacccagtccactgacctgtactgggcgctgtgctgggtgccaggcactgcttttccatattcttttctaaactgctaaaatgggtgattattcctccaggctctttgctgacactggggggaaattcttcttggttttcacacccctcttaggacgtgtcttccactctggctttacttgttcatagattcatgaaatcctcaacagagatccttgcaagtgctgaggagatagtggtgaacaaaatagataagatttctgcttttgtaaagtttacattcttctagggatcgtgtgtccttgatttggaatgcctgcttaggggggtcatgagggtataaccctggtttcctagtttccagggaatgggttgggtcattccttgtgtaacagaatattacccaactggaaccaaaaaattccttcagtgtcccttcaggcattggctttagctagtaggaggatgtagagaaattttgtgcttctgttatatctttctcatggggagctatgcagatccatctgtagggatctagatcggctacaatagtagtggccccagagaaagttgacatcagaacccctgatctacctggcatgccacctttaagggctttaacttcagctctgtgacgttccctaggaaaatcccaagaagaggtgtcccaaaccagtggtataagtaagagcttaggtcttgagtccatcactaaagaccttgggcaagttatttaatctctttaagtctcagtttgctcatctgtaaaataggatggcagtataacccatctactattttaaggattgtacgacattctgcacctaacaccttagcatagtacctaacacataggagattttagtaattattaactactatgagagaggtcaaggaggggagggagaggtgccatccatggtggataagttgtgctagcaagtgtttgtatgtggaacttttctattgttaactcttttacctctgctaatttttgccattaccaccggacccctatgtaggactcatctcctctagggtaaggtgccccgatggatcatgattatcagcatcctttttagacatggatgtaagatacttctttcttggcattctattctattctcgctggttctggattgaatccaaatactaactggggttatgtccgttttatagcaatgccatgttacaacttgtaaaccgtcatattatgtagccacttaaaggatgaagtaggccttaatctgatattatggaaagaagataatatcgactcagctgagatattaatgtatagatagataaatggggaaaaggatggtaaaaagtagtataatatgtatttataaagatttagacatatggatgcatggatatattctcaacagacctaagaaactatgaagagtgattattcaaagaaaggatgctgagacttcatggtaggagcatactaccaatttattatatgtgatttttttattatttgttttcataacatttttttaataaaaataacgttaaaataaatcttaagcacagcccccaaatatctatacttatctatgggcagtctttgtttatctcttttccacttctccagacgagatgggataaaggagattgtagaagcctggggagtcatagcactcttgttcttgtaacagttagcttttgctggtaacaaacaattccaatatttcgtggcttaaaaaaatcatatgtttgttcacatttccctgggtggaccatgtgggctgtgctcagcaggacatttcttctgatggtttcatctgggtttactcacaccactgaaattgaattgcctagaatgtcttgacacacatacttggtgatttgctgggttgcctcagttttcttatttgtggccttttcggcaggcttgcttaggcttggtcagcaagctaacttgagtctcagggaccccagtgcagcagtgtagcaatctctaactgaggagcatctttcatcccttccatatgttgcattttctgatgtctactggaccaaatcaagacacacagccaatcccagagtgagtgatgtctcgcgatggaggaagcttcacactcacctggaaaaggtatatgcaaatggggatgggataagtttgtggccattgtttgcatctacccaggcctctttaaggcaagccatgcactgaagggaataatgctctacgaggaggatgttccttaagccggaccttcatccctaaatcatctttggcacttgaattcaagatacatgtagtctctccctttttaagagcagccttctatttgcttatacgtatgcatctttcttatcttttattgtttcagcaccactgataattttgctttttggttcttttttgttccttcagtgaaatggcagcccagaggtaaggtagtcagtagtcatatacctctagtgacaaagaacaacccctggataaagcaccatgtatcttcagggagctgtgcaagcctgcatgatagagctagcaccaacggtgttctgacaagtatgtcgattctgagcttctccacagtccacctgttgggaatctatttgctttggattaaaggcaccagtgcatccagcttcaacttcacattcccctgcccttcaccatcagacagtttatttcagagatcatttgggatctaatgtgtttgcttttctgattctgctggcactggtgtatgcttcaccattggtttatggatgcacagagtaccggggtagtatagagtgagaaaatttgcatgagacctttgtaatgtgaaacttaattaaaagtgcagaggactcaaagtaacagggagctagaatgagggatgagtttgcctatctacattccaaacatactgagtcttatttgacacctcatgttggtagatagatgggcaagtgtgaggggtagtaggtatgacctgtcccactgccatgttttccaaaagctccttgtacatgcattgaattgcatacttgcaagctttatcttacaaaagcagaataaagtgcatcaaatcggcacttctatttaaaaaacaaagtctggccaggtgcagtggctcacgcctgtaatcccagcactttgggaggccgaggtgggtgaatcacgaggtcaggagttcaagactagcctgcccaacatggtgaaactctgtctctactaaaattacaaaaaaaaaaaaattttgtaattttttaactgggctagtggcaggtgcctgtaatcccagctacttgggaggctgaggcaagagaatcgcttgaacccaggaggcagaggttgcagtgagccaagattgtgctgctctactccatcttgggcaacagagtgacactccgtctcaataaataaataaataaaaattagaaaaataaagtctactcaaattattttttttccttcaccagacttgggggtttctgccctagttatgcagtttcttgctcagtggttggatttgaagtattccttaaagctcttgattgtcagtcacttttatgtagttgtcactttcagtatgtcacagtcaatagcagaaatgtgaagcttgtagacattcattttcaccctgatattcatcactcaattgagctttgtttatataaggaatctaaaaatgcacacatttatgattagtaaaaatggcatttgggaaaaacttttcaacaggagaatatttggaaacaaaatgctcccattacatccaggaggaatgtgaattttggaaatcccaaataaaatcagaattgaaaaatattaggtattctcgaatgcagtttttagacacacgtttactctgtgtattctcaccgtctagtacagctagacagagattatggggtcctggcttatgtttgggtatagcagagatgaggtgaaataaataaggtattgatttaatcctcaagaactctactcatttaaatggacagagaaaacagatgtacatgatacattcaaaggaaaaagtgtagtactctttggtacagactaaaaactcaagagtctaatgaaggagaaatcacatacgtaagagtggtacataagagaattccttggaggcagtggttctgataacacattcattcatttcaaatgtatccaggtcctactcagtgttggggtaaggagctggtgccactgttaaacaatgggcgaaagtgacagagaacctgttacctaggagcatacagttgagtggggtcaggagaggaggttagtgacatgggtggaagaggaaatcacatcatcacaatagcaaacctctaattactatctgagctaactgggataggtgacctaaaggaaagattcctgattctagcaaagcagttagcaaaggtgcacccttgcatatatccagacatgccctactaagaaagtggcactgagctgagagtgggaaaaatgagaaacagttaatttagaagcgaagagtcttctggacaacaggagtgggcaggtcatgtagatgccccaagtgggaggcagaagtcagtgcttctggactaagggaggaccatgtgggatgggggagagaatagagtggggaaatgtagtgacagcagccagcagggagtatggggagctggagggaagagccagacactcagatctatggggaaggcattgcagtattgaaaacagcttgggtgaaggcagaaccagggtggaaaaggcttagttggagaaacaaaaggagagggtttcgtggtcaaaggcagtgagaaagaaggctgagggaatgaaccaagactctattaaaaaagatgcgtcagggttaagtggggaccatttataaacttgggacatctatggacccacagtgtagtctagactcacctttgatgttgaatttgtcagtataaacggtaataacaatcacagtagctaatttttttttttttttttttttttttttttttttttttttttgagatggagtctcgctttgtctcccaggctggagtacagtggcttcatcttggcttaccgcaacttctgcctccaggttcaggtgattctcaggccttaccctcccaagaagctgggattacaggcaccaaccaccatgcctggctattttctgtaatttttagtagagagagggtttggccatgttggccaggctggtctcaaactcctgacctcaagtgatccacctgccttggcctcccaaagtgctggggttacagtcatgagccaccgtgcccagccttagtagtagctaatctttagtgtgggatttctttatgtcaggcagtgaacttactgtggtagagggctcatgactgcttccttttcaaccctacgctgtccatctgtgaacatttccttcaaatcctacctccaaggtacatcccaagtctccgcttctgatgttttcactgcctcagccttctgagccagcatcgttcctcacctccactgcagagatggcttcctagccagacatcccaagacctagttttaccttcctccaatccattatacacatgatagacaaaattacttaaaacataaatcaactatacacccattttcatagcagcatgtttacaataaaaaagaggtggaagcaactcaaattaaatgggtatacagaatgtggtttgtctataccatggaatattattcaaccttaaaagggaaagaaagggctgggcatggaggctaatgcctgtaatcccaacactttgtgaggctaaggcaggaggattaatagaacctaggagttggaaatcaacctgggcaacataacaagaccctatctgtacaaaaaaaaaaaaaaaaaagcctggcatagtggcacacacttgtagttccagctacccccaggctgaggtgggaggatcacttgagcccaggaggtggaggctgcagtgagctgtgattgcaccactgcactccagcctggacagaaatcctgttatatgtccaacatggatgaaccttaatggcattatgctaagagagataagatagtcacaaaaagacacatacagtatgattccacttatataaagtatctaaagtagtcaaattcataaagacagaaagtagagtggtggttagccagggctagaaggaggggggaatggggaatgggggttttgttttaatgggtagagatttcagatttgcaagataaagagttctacagatgtattgtacaaaatacacttacgttcattgcatcacttttcacaatagcaaagacatggaatcaacctaaatgcccatcaatgatagactggataaagaaaatgtggtacatatacatgatggaatactatgcagccataaaaaagaaaaagatcatgtcctttgcagggacatgaatggagctggaggtcattatccttagcaaactaatgcaggagcagaaaaccaaatactgcatgttctcacttataagtgagagctaaatgatgagaacgcatggacacatagagtgaaacaacacatcctggggccttttggagggtggaaggtggaaggagggagaggatcaggaaaaataactaatgggtactagccttattacctgggtgatggaataatctgtacaacaaaaccctatgacacaagttacctatgtaacaaacctgcacttgtccccgaacataaaacttaaaacaaaaatataatgtaagtagacttaacactcctgaactgtacacttaagaattgttaagattatgtgggttttttaaccacagtaaaaaaaaattcaaaaaaccaaaaagaaaacataattcagctaatcccttaaaaccttccaaaggtgtcctactgtgcttagaaagagagaaaaaatgactgttgtctataaggtcccgtaacatctcgtctctgcttccctcaaagacgtttcctattgctgtttcttctttacttttctcttgaacttctctctctcctgcttaccgtaaaacatggcaaggtcattccatcctttgcatctgcagttacttcatcctaaaattctctacgcctaaattcacaggatgaattacttgccatatttaaggctctgtattaaatttagagaagaaatttgccatttatattaggttgatacaaaagtaatcacggtaaaactgcgcttacttttgcaccaacctacgaatcataacaaaaaaaaaaaaataaagattcttaacactgttgttatcattaatggtattcattatctgtgcctcaggttgagacctggtttctcagtactatgtgaatgtaaagtttttattttgtaggatttaattttaatggcagttaagatcacccttcttcatggcaccatacatttggatgagattttaaaatataccactgatcttgagaaaagactgattttatttcaaaggagtaaccagattttgttgtgctttcttttgtcttaagtaacccttaacctttaatgcagagaggatcttccagtaaaatcccattatctggtaaaggtatttttggggggagctggccaacagatttaaaatggaggaatttttttcctatgcggttatttgagctccttatatattctggttattaatcccttgtcagataaattggtaacgaaaatatggtacatatacacagtggactactattcagctataaaaagaatgagatcctgtcatttgcaacaacatagatggaactggaggtcatgatgctgagtgcaataagccaggcacagaaagaggaactttgcatgttcttgcttatttgtgggagctaacacttaaaataattgaactcatggagacagaaagtagaaggatggttaccagaggccaggaaggatagtgtggaaggaagaaatggggctggttcatgggaacaaaacatagttaaaaagaacgaataagtcttagtgtttgctagcaaaacagggtgactgtagtcaaaaaaaatttaagtgtacatttttaaataagtaaaagagtataatcggattgtttgcagcacaaaagattaaatgcttaaggagatggagacccatttaccctgatgtgattattaagcattgcagatctgtaccaaaatatctcatgtaactcataaatatatacacttaccatgttctcccaaacatgaaaaatataaaattttcaaaatagaaaaaactgtaggagaagtcagatttgaggagatgtaaaataaactatatccctgataatgcaggagacgctccataagtgatgggatgtttactcaaaggcaaatgtgaagttggccaaccttagacaattggccacatgcgattcagggcaggggtggtgtctgttcctgtgattgaagcagcttcatatcaggctcctgtcttcctagggatgcttatagttactgaaagcttctgactgtaacttcctctatcctgagctctttgatgggagtcagtagagaaagagaagagtggaaacatatgtatgctctcttcctcattataaagatttatttttattagcccctttgtctcatgtggctggcattgaacagccacaccggaaccattattggattctgcaagcatctctgaaagccggcttttcagtcacctcaagttgaagtgtttttgagatttgaactgcttttgttcgtggaaggtcacatgtgatgccacagaagccaactcccagtttcccgatgccgttctgctcttgttgttgatgacacgctgagtccctgacctggctaagctccctcactaagaaagatgtgattttggtcacagaggagaccaggtgagggacagcaggcacagatgacaacacattattatcattcatttgttcactgactacccaagcaattggagtctgttggattccatgtgatggagaagtcgggaggatgaaagcctgcgtatgcctccagaggctccctaccaaatgatttttaatagtctgtatccctcccacaaacacagttggttactctactgggcaatgaagtttaaaggttggagaggctccaaatctgggcacagagaaatctcagcttaattgtcccaaactattaaaaaaaagacaacaatttgttgccagtacctggcggactgctaaaggtttttgtcatttgttaagtagtgttgcacccttagtgctgcacccttaaaaaaaaaaaaaggaaaaaaaggtatgccctctttaatacttactagtggctgactcataattttaagcatgaaagacaaggagtggatttgaaatgtggtgtgtgctgcttctgtctcccacggcagcatccaatgctgtcacgagctgttaaatgatgagttctgaggggtgtatgtttaaaagcaacattgaggttgcaagcatccaggaccattgaggtagcgtggatcagaatggcttttccacgtaagagcaggcactggataaagcccagtgtgcctcctggtgttacgctgggttggtggaaaagcctctggaaaatcccaaaagagaaagatggaggagcgaagagtgtgatactctgatactcagatgtgttggtgcccccataaaaggggttcacaggaaatagggaggaataggccagtgtgctggttcactttggcttgacacatgcaaattgcctaaaatctcttctatgctttttcttagtgtctatcatgtagcagaaatgaatccctcttggtagattgagaatatcatacgcaaaatgaagacctgggaattttcctgctctgttcctaggccctggactgacatgggagaattttaaaacatgcgcttttagaatcaaaattagttttcatgtctgcagagacaaggagcccatggaaactaccaactggcattgctgagaataattattgtcaaattgagtccattgtgaatagtcctcatacataattgccctggttagaatgagcgccaaagagggagctttaatatttactaactccctggtgaagaaagaaaccttttgctttattaaaggctgtggtgatagtaatttgctgatggaatgcattagtgacatgcactatagatggattttataagaagacattgtccagaagagattattcaaattctactagtggctttcctctttgtagaagtatctagacttgaagtcacggctttcttcttttgataatatcttgattcagtaggaaaccagtgcctgtgcagctctttgtaggagtgtctatttcataaagttcagattatgtcagtatttcataacagccaggtctttccctgagacttacccctacagggataagagaacaagcaggacatggtggcttatacctgtaatccaagccctctgagaggccaaggcaggaggatcccttgagcccaggagttcaagaccagtgtatgcaacatagtaagacctctcttctctacaaataaaatgaaaaaaaaaaaggaattcgccaggcatgatggtgcatgcctgtggtcccacttacttgggttgctgaggtcgtaggattgcttgagcccaggaggttgaggctgcagtgaaccatgatcacaccactgcattccagcctgggtaacagagcaagaccctgtatcaaaaaaaaaaaaaaaaggtaagagaaaaagagatttatgcatgtatttaatgaaaaacatacattatcattagattaataaaacttcaatcaagagtgctcaaaattcaagcctcgggtaggatagggaatgcgttgcattcaggccttggacatgtttttcttggataggtcatggagttgaggggtaagcatgggacaagtccagcatcagaccaaagaagcctaatgtagagggtctggaccaagactgggtgttgctagacattacacaagagcctctttttagtcttctgcctccaatggacacccatgactgatcctaggaaatgttacacatttccagagttctcccaagaaaatgggaatatctgtgaggctttctagttcagtccccacatgctatgaggacccttgctgtcttgtgttttggagaccgtgacgtcactgtcttgtttctgtggccacaggagagtcagtcagcaggagcaagaggatggagtagtctcattgtcttagccacagccaagcctaagctttgctctaggtcaaatgatccaatgctggcccatgaaggggagtcaactgactttattttgaaggtttttaactagagagaatgtcaactctgcattggccttctatcttttgctgttacacatgaagttttgtattgggatggaaaggagaagcagaataattttgttacgaattcctacttctcatcgatgtctccttcccactgtgaaaatacaaaatagcacatcaatcaatatggcacagtattgaagaatccaagtcagccagttctagtctggcttcaaatcccagctctaccacccattcttaagtgaaatcttaggtagctctctgagcttcagcgacttcatctgtaaactcatgagagtaagaatgcctagcatattggggcttaggtaagagtaaatgagttagtgaatgctgggcacttagcacagtggttgccacgtagcaaatgcctggcaaagggactgggctgctggtagtgattctgtcagcttctcctccttgttgtctaactttgtgcttggatagcattccttatggcctcatatctacacatcaaacttttcaggggaagagagagcacattggactcatgactctgtgtaaaagtttggagaccatgaggccgggcgcggtggctcacgtctgtaatctcatcactttgggaggtcgaggcaggcggatcacctgaggtcaggagttcgagaccagcctagccaacatggtgaaaacctgtctctactaaaaatacaaaaattagctgggcagggtggcacacgcctgtaatgacagctattcgggaggccgaggcagaagaatcacttgaacttgggaggcggaggttgtagtgagccgaaatcgcaccattgcactccagcctgggggacaagagtgagacttcgtctcaaaaacaaacaaacaaacaaaaaaaaacaaagtctggaaaccatgacatcattgtcttgtttctgtggccactgcagagccaatcagttcaagcgagagggtggagtgttctcattggtttggactaggacgcataatccaatactgtcacctgagggggcgtcaggctgaaagagatccccaagtggaaaacgggctgatgggaagaacagaaatagggaaaataaagatggaggaggctcaacacatgtccactgtgctttgcaaatggcgcatgtccaccttacagagaatcaacacctcaaggcatgaactgtgttgctctgtaagtccgtagccattggtcgtcaagaatgagcttccctgtcattaggtgaacccagaagtaatcagccctaggtgtcacgttccatccagtgctctttctgcttttgagccacttactgaaaggcttatctcccatcctttggggatgctctctgcttaaaaggatgtttagaatgccatttgtagcacacacacgtacacgggcaatcctttccacttcatcttaccatattcatctgaatctggcttcccgagagtctctgtagtatggcgtggaggcttaagagcttctgtgtctttcagagggtagaaggagattcagtcgactttcttttgcccacatgaattgatgctatgctcctttaagtgccaggtttagtcccctgctgagatcacacttacctcaactaaattatttttcatttaaaagcagccatccattcacagtcttttatttgtgtttcaatgatgtttgtaaatgtgctctagcagttgaaagtgtaggcacgtatgtgggggagcattcctgatgttcccctcaccacgcatttgtgtacccctcacatgccctttgtctgtgtctcatccatctctaacatgaccacaaaaatggtgtctcctgaagtgttcaaggatctaccctcctccatagtcatgaagtttctagtaataatggtaattattcttattgtaataaggaggaaggggtggaggagaaaaaagtgatggagaaaaatggtgtctcctgaagtgttcatggatccgccctcccttgtagtcatggagtttccaataataatgataattattttaataaggaggaaggggaggaggagaaaaaagagggagagaaaaggggagaatgaggacatgaaggaggaagagaaggagttggagaatgaaaagaaaaacaagaacaaaaacaaccagagaaataacagtgtagtattagcacatctttgacacaagcttcaataatttctgaagaagtgaaggaaggaagaaaagaatggaaggaaggaaaggagagaaggagagaagaaatgggtgtatattacaggtttacttatgtgctaagtcctgtggtcagaccttgacatttcattttctcctgtaatgttcactctggctatacaagatcagtgatttcattatttgcactttctagataaggatgctgagcaaagtggcttacttttctgtattcttcctctcctgacccatccattttatgctcagctgctaggcttgtctttgtcagacacattgcttatgccagtcttctactcaaacaaccttcagaagttcccagttgagcattacgtaaaaccaaacatatgagcctgagatttagagtcctcccattttggtcctggacatatttttcttagaatctaagacataactaatatgctgtctacccactttgggtcatacccaaatggccagttacattgttcccatgtcttcccttgagagcagacatttatgaacctctgtttaaatagaataatttttttctaaagaagcctttttatggatcaaaatccttccattattctctgtgcttacagagtcttaagtctaaataatctctttaatctgcctgccttctcttattccatttctcaaaaccctcccctgctttgacttcaggctaccccatacctccactgtgctgaactaatgttagccataaacatacttgcacctgctgtttcctttacctggaacagctccttcatccgcctgaagtctctcacccaccctaatggcctcttgggtgaatttcactctatcctttaacacctagctcaaatgtcagctttgcataattttccttgactctcctagatggaatgagtctgtgaaacctgtatttttttaggtactggtactgaaatacctgaaccctgtatttagacttcctggttttattttttattttattttattttttgagacagagtcttgctctgtatcccagagcaatggtacactccaatcccggagctggagtgcaatgatagaatcttggctcactgtaacttccgccgcccaggttcaagcagttcttctgcttcagcctcccgagtagctgggattacaggcatgtgccaccatgcctggctaatacttgtatttttagtagtgacaggattttgccatgttggccaggctagtctcgaactcctgacctcaggtgagacttcttgtctttaaattttagctctgccttctatgaaatgtgtgagtttagataagctgctatctaatcctcagtttcttcatctgtaaaatggacataggcttcaaacccatatcacatagttgtaagaaataataaaaggtgatcatggaacacttagcagtattcaacagtagcactcaacagcccctgttgttaagattattttatgttcatatgtttaaaatgtctttgtttcagaggaaaaactcctcaaacataaggcttgttaattttttataaccctagcactttgtacatgaagagtgactagttcataaaacccaacactttcatggaattgaaaaatacttttttattgaataaggcattggaagacaatctgttgattgtcaagatttcagtaacatcaccaattattcgtggtgctagttgcaagtaaaatgaaaaaatgttgttttctccattctcattgtggtttggggtaacttcgattaaaatgcatatataaaccagtaatttcaccaatagttggtagagacattgcaacacaaaacctgcccaggtgtggaggatgggcatacagtggggtattatgggaatgttgcatttgaaaaagagccccagtcttggcaccttgacatcttcctgggaaaactaaccgctttcctccacaaatatgctctgggggcagagataaagtatgaggctaggtcagaagctgtgagcataaattcctactagtgtagacatcaacataatgaatgttccttttagcctctcattccaaatatagaggtggaaggcatgtccaaggttgtgacacaggatgactggcttgttgtgggccacttgtgaccaagacatttcccagtacatgctggttcctaatttaggtccttggctcgcttctgacaagccactttatggaagggcgtgatgatatatggccttcccctgctgaacagctcgcattttgacatcacccacaattctgcatattcagtttgctctaatccagacataactgttctcccttcacctttagtattcaaggttgcatcctgatccgaatacatctgtgtttggggcaaaactggagggtcgtcaattaatcttaggcatgacagtttattactccctgaagtctctctttctccttctctgctggacagagaaacagagaattcccatttctgataccagtgtctcctgtctcccagctggcttctctttggcagcacttctccacctacactgccgaagtgggagaggatgtgaggatttatattcaaggagaatttagaaatgctttgtgtttcagagagtgctttgcctgggtgtttaatcccgtgaccatcaaacccctcgagatagtacttgatggctacaataaactggcctctttcctattgtctcttcttgattacaaaccctgtcttgcacgatggtttcaaaattatcctcctgcactttctgccacatcccttcatggccaagatttttccaagttgtaaaatatttttgcttttcttccattcgttattttattttccaattcttaaaagtacataaccagagattgtatgagaaataaatgtcttataaagtctggggccttaatacttgtggtgatgataatgagatgtcgatagtagtgatgatggtgatggtaattgtgatgatggctattttgcattttggagacatgagacccactgagttaaatgatgttcttgatgcctcattgactctgaagttcttgtctgtctttgttgaactaattcaagttggagattttccttttgtttcttttcacccctaaatgtcaccattcctgcaatggatgaaaatgtggatttgttttttaggaagtctaagtggatgagattaatagcctgccctgtggtttgttaaataaacttgataaggttttattgattaccttgagggttgtctgggccaaacaccatgtaccatttaagaaacaaacattagttaagaaaagttttcatctcacttgaggaggggaaaaaattattgcaagatacgtgatccagggaaaggacaaactgagagattcatggctcaaggctttctgtgggtgtcaagttgggggtcatggggaaagaaaaagtgcaccaatcaggggccaggtgatgaccgtgtgtcatttcaattaatgtgcttctattatacagatgggcacactgagagtcagttattttgtgtagttttctctgggtcatgtagatctgattccagttcaaaatcatgctctggcacctcctgtgctgggaaaacatcctgggaaggtgaaattcagaccacttactgcctccagctcttggggcttcttgacattgtcctagtgtttgccttaagggccacccggagtaactgccctttgaattttatctatgtatgtatctgtccatccgtccgtccgtccatccatccatccatctatctctgtctgtctgtctatccatctatctatccatctgtctgtctgtctgtgtgtctgtctatctatctatctatctatctatctatctatctatctatctatctatctgtcttcctgcagaagtagcaaacgtgccccgttcttccctggagctagcaaaagcagggatagcatttggtcagagttcagccacacacttcttttctttctggcttaccaccacctagtggggccagaaaataaagggggaaatattttctcagtgggctcccaaggactgtgagaagataaacacttaattctaactactttctcccttctcggtgagaagctgccacccatcgtatgcacaaagtggaaaggcacaaagtggaaagcttgacttgccaagccagccaaatgtctctgcagtcaagatatggggggaaccgtctgtgtaatttatctctaaaatggaattggtaatacctgccctgcctaccacactgggttgagtgaagagtgggagtgctctgtgcaccagaaagggtcaaatgaaatgagaatagtcaggtgatactattgtgttgcattgtcattgcagttaatacttccttttggagaagaaatactgtacatggggatatagccctccaccttgggaaaacccagagaatattcatttctgatggaaactgtggctgggcgcagtggctcatggctgtaatcccagcactttgggaggccaactcaggaagatcacctgaggtcaagagttggagaccaacctggccaacatgacaaaaccccgtctgcactaaaaatacaaaaattagccaggcgtggtggtacatgcctgcaattccagctactcaggaggctgaggccagagaattgcttgaacccgggaggtggaggttgcagtgagctgagatcacgctactgcactgcagtctgggtgacaagaatggaactctgtctcaaaaagataatagaagaaaactctgcgagaactaccaattacccaccacctattgtatgcccggttctgtattagcaactcagtagacactttcttatttagtgtctaaggtcttcattatctccatttcataggactgagggttagcaagatgaaaggacttaaccagaactaaggcaactgatatataccagaactgtgggtttggccccatgctcttaaccacccttctgcaatgactgagcaggtgctttgggtcagtaggcatggtattaaactatcagtctgtcttccttcctgggagagacacaaaaacattgagaactcatgggcatgtttccaccgtgcaggtgctaaggtttcttatttcgtgaccagagaccaggcacattcagtgaactgcttcattcggaggtgcttggagcttcttcatggccatcctttgcaacttggagtatgcaaacaacatttcttctctaaattaaaagcttccaaagttatgatggtatgtgctttttaaagaaaggatgtattcaaaatttaaagcgatgttgaattttgatagtattgctttgtaggttgttaaattgtggctttagacaatgagttgtttatagaactacaaaatccttgtgaggaattcagatttgtctacctttcttagagggtcctaatgaggttgtgttttaagaaatgttacatagactataaaatcctaatttttaaaacaatctggttcattgtctgaagggcctcatttaacacatagtctctgtacacttggtaaaaatcataaaatgaaattattcaacgtaactgccatatcagtgggactatttgtttataagcaaaaaaacattggttctaacttgtgaaaaaaaataattcattagaaagatatgtgggcacctttagcttgaaggggagggctgaagactatctttgaaaagggcaggacccaggacagttctgcagggcctcagcagcaggaaccctgcttagtttgatccagacacccttagaacctctaagtggcttcgtttcgatcaagtgccagtcccttgatttggttataccaagccatctgcttaattaaccccacaaagcaggtataaggaggcagagggaacttccaaaaaggactttgaagtgctattgtcaatagaaagtaggcagacgttgctgagagaaaaaaatccaataaaatttctgtgaataaccagtgttggaaagagtgtagggggggaaaaaaataattgcttcgccactagagagatgtaaattggcataaattttccgaagggtaatttgtcaatttatatcaaaacctttttacaatgtttagatcctttaatcaagcaattccacgcacaggaatagcggctgacgacaatcaggcaggtgggaagcaggcttactagaggctcaaaatggtgtttttctgtaattgtgaataaatgggagaagaaaaatacctaacaatgggtattgcttaaattatagcaaatagacattatgacagggaagcctaggctgtgctactgttgctcattggtcaaggaaaaggtgcatgcacgtttttaaagaatggatatgttaatttctgaagcccaagacatccctgtctaacattccactactaattgcatttctcctcctcatttaattttaattaaacctttccttccctctctccctcccttcctcatttcttttttctcttccttcccttccctcccctcccctcccgtcccctctcctctcctctcttctcttcctctcccctctcctcccgttttatcccctccccttcgcttttccctccctccttcctctcctctcctctccttccctcgctctctttgtctttctctctttaatcttttttccttaaaacaccagcaatcacacatgttaaggccatattatgtttcaaagaaatacttgtaggctagcttaggaattctggctaattatagccttgtttggatagccagaaaacaacaacaagaaaaaaaaattgcaaaatttctgggacttgactttagatacgctttgtaaacatgatttctatctcctgtacaactgtgattcttaaagctaaatagtgaggaatcctcatgtctaaaaatggaaggcttagagttaggactaagaaatgaagtccttatcactggcccattttaatctgtgtttgggtcttgttgaattcgagctaagggaaggggaatacttcttttgcagggctcaggaattaaaagttcagctctcacttttctcaccaaggttatcgaccagcttctacaaagccaaatatttgttttctaatgaaagtgttaggagatttggcagagtaaaaacgtccttgcatctagaaaaactggcatgtgttttctttgaatcaatttccaaagattatgcagtatcttttaatggcactctggggacccacagtgtgtgtgtgtgtgtgtgtgtgtgtgtgtgtgtgtgtgtgtcttaaaaattaggatgaacattttatgtctcccaagtagataaacctctgccctacccccagtgaagagatcataaagcacaatgttattaattcagaagtgatgggagggaatgccataattccagagatgatatttgttaaaatattgatggcttaccactttcccctgttggattaatttttacccaagctggccatttatcagaaggtacataatgccatcgtattgggaagatttttttttgaaagatatttatgaagacatcaacttcagtcaatgaaattagacagttaaaagatggcaaaatatgctttggcttagcataaggaaagcaattctggatgaagctgtttctattaatttagctgacaggaaagtgtgagggtggcttgtaaagttaaatatgacctgttcagaaaccataacttgggttggcattcagtaccggggttaatactaataaccaggttaatctttaggtacagtacctaagaaacagtgaaccataagaagggatattttggtaaaggagactgaattgtgtcttcttctgcttaacccatttttatgccttccatgtgcactgataatgcaacccaaacctttgccttgacctgcaggttttgtggggtatagccccttcctgctcacaaacttctctctctagccacactctttgtttctcttccttgatcccacctaagttcattttggactcggggacttcgctttactcctggctttgggatgttgtccaggttctttaaagaaccagctccttcttatcttttaggcatcaaagaaccattgtccatcctacataagaaaactccttcctgggagtcactagcatttaatacgtttattcatatttactgctctttaaaataatcttatgtgtttgtttgaattgttcaattgcctttttctgccaactggaacgtaggtagcatggggtgactgtctttgtcctgcttactcatctctctcttctcagcatgcagaggaatatctgataaagagcaagtacttgggaaatacctgaggagggaaggaagagaagaaggaagagacagagggagggggggttagtactggcaataagttgataaagctactagccatttggacgacagaggtgtttagatggtttggtgtggggctgaggggcatcggaagctgtgattttgattgtgtctatgaacttggcaatgttaacggtcattgaacatgggtgcacattttgtccaatgcagtgaagaactctgaaggcagctccagtctttcagtggggtgtgcccatacttgatcactatcaccctatgctaactggatgactttggtacgctacttacccttttttgaccttgcctttcagtctgtattatgagtgcatctgtcaaatcagagattttcacattctcaagattttatccaatcttcaaatacatcataagtatgtttgttttaatgtcatgaattgttcaaatctgttaaagaacttcaaaattatacattcatcagaacagccacatagccccattggttgactataaaaaagcgactattacatcctcatgaaatgccacttatttagttacattttgaaggtacaggtaagattttctttgaaaaaaatgtgccttgctaccacagttttttatatttaatttttatgagtacataataggtatagatacttatgggatgcatgagacattttgatacagggatacaatgtgtaatacacacatcatggagaatggggtcttcatccctcatgcatttatcctttgtggtataaataaatccaattacactctttattttaaaatgtacaggtaagttattattgagtatagtcaccctgttgtgctatcaaacactaggtcttattcattctatttcatgtacccattaaccacccttatttcctcccccgacactacctttcccagcctctggtaaccatccctgtactctctatctccgtgagttctatcatttttatttctagatcccacagattagtgagaatatgcactgtgtgactttctgtgcctgacttatttcacttaacacaatgatctccagttcattctgtgttgttgcaaatgactgtatctcgttcctttatatggctgaatagtactccattgtgtgcataccacacttgctgtgtgcattcatctgttgatgggcacttaggttatttccagatctttttatggcagcagtgtttaccgtagttctacaaactcactttcgaagcgtgtttgtcttccatgttacctcgttagacatcaagttcctagtaaacatttaggatgagggtaagggtaccacaaggttgtgggcacagtttttgagtttgttttgtgttaaaagggcctgtggaggattgtgtttgtgttctgggactgccataacaaagtagcacagacttctctcacatttctagaggcttaaagtctgaaatcaagatgtctgctgggccatgctccctgtgagggctctaagaaggaaacctacctggcttgtccacagcctccgttggttgtcagcatccttggcattccttggtgtgtattgtcattgccccaccttcttcctccatcacctggctccttctctgtgtgtctgagtctatgtgtctccaaatctccctctctttataaggacaccattccctggatttagggcccatcctgagccagtatgacctcatcttaactaattatatcggcaaggaccctatttccaaataaggtcacttctgagtatctgggtaaacataaattttcagaggacactcttagtacagagatcttcatgttagtgggaataggctgggttactgtttgtacaggacattccctccctccacctaaattatcaacacaaaactgtaaaacagagatatttggtcaacctgtatttattgggaattgcttgcaaacatcctgaactatagtaagtgttagaaggcaaacaagaagataagaacaattctagcttgaagaactgtgtgatgtcactgaggagcaaagtggcactcagagaaccactgcagaattatcaaatcctaaacttactggggagtatgtgatgttagagtttggagaagtgcttgatgaatttgggctggtgtagttgagtacacttctcctgagcaagagcgtgagctgagccatgaagcattggtaggaccctggagacattgagaagtgatgctataaggtatcttaaaagtcaatgaagatgtttgtgctcaagtcaggagcaaatgcatgtttcactttgttggttggtgctgctataacaaaacatcacagactgggtaatttctaaagaacagaaatttatttttcattgttctggagactgggaattttcagacttgggaaatgtcacatgaaggcaccagcaggtctggtgtctggagagaaccccgtctctacttcctagatggtgtcttgttgctgtgttcactggtgggaggaacactgtgcttttaggtggtggaaaggagggaagggctgaaaaatggtcttactattgtctccagcaattttatagggtcatgaatcccattcatgagagcttttctcccataacttaagcgcttcataaaggcaattcacaactaagtttgaacacatgaattttgaagtagacacaaacattcagaccatagcacacaggaaatgcctgtgtctgctacaagcagagaaaaaaagcaagggaactaatggtggctgaatgcgggaagtaaaggtcaagtaaaaatgaccccaagatatccagtatgagattgggaaaaatggaattaaacacttggaaatggtgttctcatcacttacatgaccaggttttcattccttggatgtgcgatagggtaagaagataaagtgagtcatggaatctttacttgaaatgcaattcaataaacatccacctcaccaaaccattctttatttcaggactggatgaattaattcgagtgtttaaaaaagagggggctcaccccaatgtttctgccaccattgagtaatagagtattgggtttcctatcgtgctgttatgattgggacaagcggagccatttgtcttttgctacatgggagaggtgttaataccaagcacatccagttatgttgtgaaaggctctgttgtaattagtctgagtcgaatcatcaatcaagagattctgcaattataagcaccagtcacactacattgctgtagaaggcggtcattcatgctacagcaatacttgtctattaggtctgaggctagatgctttatacacaatatctcatttaattcttaatgaaataccctaagagggccaggcacagtggctcatgcctgtaatcccagcactttgggaggtggaggtgggcagatcacgaggtcaggaaatcaagaccatcctggctaacatggagaaaccccgtgtctactaaaaatacaaaaaattagccgggcgtggtggtgggcacctgtagtcccagctactagggaggctgaggcaggagaatggcttgaacctgggaggcagagcttgcagcgagccgagattgcactaccacactccacccttggcaacagagcgagactctgtctcaaaaaaaaaaaaaaaaaaaaaaaaaaaaaacaaccagaaaaacagaaatactctaagaggtaggtattattactatccccatggtacataaaagatataatcacagagagattaaataaatcacccaagatcacatgcctgtgcattcacagaagagaaattcaaatctggaaatccaacttaaatctgcttttaaacgttattattagccgcctcccaaaagaatttgactatatttttccattagtctctttgtacccattgcctttctttttaaattattttatttattattcaatatgttaaaaccttttaaaacattcaaaaatataaaaagggatatagggaaaaagtaagtctcctatctacctatgatctctgactccacatttccctttccagaagtaaagacgcgttaccagtttgttttgtattttttgtattgtctgtatattttcagaaatgtgatatcttaggtatatactaagaggggtgtgtatgtgtgtgtatgtgtgtgtatcctctccttccttcctcccccaacaaagtgatttctgtacaggctacttcgtccttccccccatcacttaatgtatttttggggcttgggggtgtctatgttgccagcctgtgaaacacgtggataaatattcaagttgaatgtataatttttatggatttttggttatgtttctgtctgttcactgcctcattcaggccacttgaaacacatttttgttttattatttaggaccctctaaattgtaattgcatgcacctgcaatgatgtggaaacccccttatcttgaggactggtcttgattgtgttcaaagccacatatttaaggagactggagagcctgtggtttatcctcctgagtcagagcctgaaatcgttgaccctaaacccagagtgttttgtctctcaccttgtgggcgagttaatggttgccactccgagctgctgcctctgtagggtagggacgtgtggatgcacacagcagaggctctcataaggataaaggcctccttatgcacaattcaaaagagtgaccacacccctcagtcacgattccatgctttatccactttcttcctttgttgtcccttttcccatggcatcgctgaaccgtcatttcctattcatgtttcatgctctccttacctgtgtgttgatttgcatggatttctctatgttgaatttccttctaccttacatcctttccaccctcaaagatcaacaaaatcttgtcaccttcaggaaacctttcctgattcacccaactggaatccttccctttcttttacctaaaccttgattctgttatctttgtcttcggcacttttatcctccccccataaattgccctgctcatagtagttgctcaataaatatttgatgccaatcccatggaaataccagcatatgtgtgcatgcccttcaactctcagagacaattagacttccacttcccaaacttaggatgcctcactcattagagaattgacaagctgcctaactgtttgcacagtctccaacacattataaatatttggataagtccaccatcaatgcacagtcattgcagagccaataaaacatgaccttgactttctcctgtttgtttacatgcaccctacagcatcatctccaaaggcaacaggagcaaatggtgaacagctgggcaaaggaggtgtccttcacacgtcctatatttggaactggtggaaatagccagtatgattctgtgtcagtttaacaggatagatacgattttaaaatgacatcttcattgtgaaccagctgtgggcaggggctcatcttgatatcacttgtgctaggctttgagtagggcagagtttctcaaccactccagtattgatatttgggaccagatacttcttggttcaggggagctgtcctgtacactctacgatggttagcagcaccttgcttcaacccactaggtgacagtagcattccacaccccacctcccatccaaggccaggttgtgccaaacaaaaatgtctccaggcattcccaaatgtctcctggtggaagaaattggtgtaggggccagaggaatatttattaaatgaacaggtaaaattatccatgtttgaacattatcaatttctatttctctacatgaagaacaattaatcctccttggcaggtgtgcaagagaaacgcattttactcaatacctaattaattggttaaaaaacaaaaaaacttcttgtaaaccgcccccaaattctagctgccaccttgttatactccgaaatgtggtgaatttgtgcctccatctgttacccaatctatataacttgacatttgctaaaaagtaccctattaaagagggttgtttttattgtaaactacttttcaaataaaagcatattgcattgactgtaagttctactatgcataaaaaataatttaccctgtccaggcacggtggctcatgcctgtaatcccagcagtttgggaggtggaggcaggcagatcaagttcagaaggtggagaccagcctgaccaacttggtgataccccatctctactaaaaatacaaaaatcagttgggtgtggtggcacacacctgtaatcccggctacttgggagactgaagcaggaaaatcgcttgaacctagcaggcagaggttgcagtaagtcgacattgcaccactgcactgcagcctgggtgacagagactccatctcaaataataataataattattattaataatatattattatttatcctaaatgtaacattgagtcagctgttttcactgatagcacagctatggtatgaagtaagatactacaggtatattgaaataagaaccattagtgatttattgctaaataattgcatagactccacaacacgtacggaagaaggtgtttaaagttctacaaaacgccaagttgtagtaacacttgagaatctgaactgcatgtcttgttgatatttctttaacatttttattaaatattatccctagtttattgaacagagtcagctcagtgagatataaacatgaggtgactttttctccactcactgctcccaaattcagaattgcatattcttccccttcccctagaaataactcagatttttcaactttctggtcccttttggttattagatatagtctcaatgggtatttatgtctctgtcattttctctttcaaagtagctattttacaatgtgtttaaagtttcttttcttcccttgtcagtcagacttgtagcttccgaaaaggagacagtgtgtggtgtttttctttcctccccttcttttatcttagaatgaagagggaggattttgtatgactttggagcattttttcctttcttcttccggccctctagatctgatggagtttgggggcaggaagaagcggcaaagagtcatagctctcaagctcaacagtgtgcttgcattcctcttatttggcatggtaagcatgagtgagtttactgtcactcacatagttccagcagaaacagctgagcttgagccagtttggtgctacattccaagaggctcacctgcaagatggggagacagtgggctgtagcaacattgttgctatttgtctggtttctttgttgtaaatattcaaattctttctttctcacgatgcataactatcacagatacctcaaatagacatgcaggggcttctttgctccttgtattagtctattttcacgctgctgataaagacatacctgaaactgggtaatttacaaagaaaaagagattgaatggattcacaattccacatggctggggaggcctcacaatcatggtggaaggaggagcaagttatgtcttacatagatggtggcaggtgaagagagagagcttctgcaggggaactcccttttataaaccgtcccttccccacccccatctcatgagacttattcactatcactaaaacagcacgggaaacacctgcccccatgattcaattaccttccaccggatccctcctacaacatgtgggaattgtaagagatataattcaagatgagatttgcatagggtcacagccaaaccatatcactcctgtttcttgatttggaagatccggctccagaaaaaccccaatcacctcccttcctggtgtctgttccaaccatgcatcgcacaggccattgtcccccaccttgcaggtgagcctcttgaaatgtactagcaaactggcccaagctcagctatttctactggaactgcatgagtgacagtcaagtcacttgtgcttaccatgcccagtagtaggatccaggttgtttccctgcttcccttattcccactctgcccccggtttttcccaaattctatttttctccagcgctcagggacatctctgagacagccatcaagtttgctgtgtctgtagacttctaactggggaaagacatttcaacctccccttgttgcaggagcctctggtatttgcaggtacttcacttagcatggactcatggctttgtgggtgagctgaggagcaggtaccagagctctcagacataggatcagttttcttaagacatcttactcgttgctagattgttcctaagacctatggatgtcctgattatgattacatttaggacaggttctcatgaacgtgggaaaatggtgaaatatttttacttttcatagtttttaattttaatatcattggcttttggaaaatacctattgttttaaaacagctacctagggtttcaataaaagtggccttaatgttctattcctcagtgtacgaatgacccattctcggagcatatgttgtctagtagcccttgtcctgcctttctaggagatagagtttctcatggacccaaacagggcttcttaatggagatttataacatcaaaagggattacatgagaacaaagtaattatccttcgtgtatgagtatcaacccaatttacgaaggagtgaaattagacactgcagttaattacagggacagtctcaactttgtggaccaattagggctcattggttgcaagcaacaggaaccaattccccttctacattaagcaaaaagaatacttattagcagtagtcagtgagcttacaaaatttagaggtagttgaaaaagcagtgttggtagcatgacaggcaccaagccactgtgaggtctcctccatgggaagaaatgaattccaactaagtcttccgtccatgtatcattctgctccagttctggatcccagaagagcacatcccattggccagacttaggcaatacctccccttcttgagctcaccctggctgggagagctaagatgtcaaagaaagttcctttaggaaactctttatcttccagagtgggaaggcaaagtacccaatgtatggtcttacaaaggctgcataaaatgggggagctgtaacttctcttgggtactcttaggaaaaggaagcaccaaccagtgagcaagtgatctccattcccttttcatagagaaggtcgatttctatcctcttgcctggagggtttcagagctgccctaggctgtactccactccagggtggccctcagagaccattactgtttcctcatttcttgaatgtatggaggaccctccagttactttctgctttaaggcgatgtttattaaacattgtttctattagggctgtgctccttcctctgtaccctttaaatattcatctccctcatgctgccatccccttcatggagatcattcctgcagagcggtagtccagtttgctctacttcctggtgatcgtctcttctcgagatttcttcctgcacatgcacactctggactgtgcacttttctgctctggattcctctcctggacagttgcactggactccattcccatttgtctgagcttagggtttatgtctttttagggcatttaccgtccccactcctgtgttaccgtctctctgtgctcctagcatgtacacattgtggaatgtgagaaggcaaagatctcagactttccatgtgaattgaagacccttctctggccccttgagtgccagtgtcaccaacaccactggtcactctcctctcactttctacctgtacaaaggacagtctcccagtgtccctgtggaacattgtgattactcgaagttgtcctagctacttgggaatgagtcctaagaagattcatcttacttctgatgcatcacatgctctgtgttgcaaagcacacttggcatagccaggagcatcctaggttggcctagtgctagatggcaggcattgaaaactgtcaacaccagtacaggaacaggaaagacaaaccatggaactagatgagaccctgatactgagttgtggacagatcaactatagtgatacaggattcttgattgtctgcaacagagaacttttctaagtaacctatgcacatgataatttgatttgaatgcttttggggagaatgcagtatcatcaggaaaatttgagaacctggctcagaaaatagacaaaagggatgaaggtaccattaggatccctgggtagaaactccctgctaaggatgctgttaccagcactgtgatcactgccacgtggcaccaccagcatccatagtcctgaacacagagcagtggttctggactctacacttgacacagcctccagggatggtgcttgattgatcctgtgcttttacctagccccttaagacccaagacatatggtaacatacagagtcaagtgattttttttttttccttgaaaaagcaccagtgcaatttgaggaggaaaagcaagtcttttcaacaaataatcctggacctactggatgctggaatggaaacatttaactcagatccatgttttccatcgtagacacaaattaactgaagataggttgcagacctgactacaaaagcaaacactcgaaagcccctggaagggaacataaacatctgcctttgaaaactgagcatggtcaacattttcccagataaaacacagtacgtactaaacataaaagagaagtttgacagacttcctcaaaattaaaaactttgtcccataaaaagacattaagagaatgaaaagtcaagctgcaaggaggaaatataacaatgtatattatatatatgtgtgtatatatacacacacacatacacacatatacatacatacacaaagagctgtggctctggacttaaatattttatcaagagaaatgaaaacatatctgcacataaggcttcttcagagatgctcattgcatgtttatttgcaatggcaaaagaagaaaaaagggaaattacccaaacatccatcaataaatgaatgcataagtaagttgtatagtcactcaatgaaatgctatccagcaataaaaagaaatgaattgctgacaaggacatcagtgtgtatgtgtgtgtgtgtgtgtgtgtgcatatgcgtatgtgtataacatactcagcaagagaagttatccaccaaagagtccatgctttatggttctagttttatgaagctgacgaacaggagaaattggcctatggggatggaattcaggatagtgattgtctttcacccgctaagatgcctcttcagtttctacccaaagacttcatatatatttacctctaggctgtccacaaaatggagatgtgtgaatcatgcttttcatgccattgggaaaggacatcctgttcacagcagaggtgatacaggagcattaatcaccaaatgtttagtaaatattgatacccgggtgatttacactaatcgtcacaagaccgcaatctaccttttatataaatgcaataaaaaaatcttggttataaaagtacttgcttcctttgcattttttctgctgggggagaagcacagaatgcaaagagggagaagggaattttctaaggagatggcatttctatgcactttgactggggtactggttcatgtatatgtgtgtgttggcaaaacaccatggaactgtatacttaagatctgtgcagttcatgtaattacacatgaatgaccatgaaaagtccaatgaggcatatcctagtggtcaagcctggtcatatgtgcgcattcaacatacagaaaacttgtttggtttctgtagcaggaggtatgagctttctgcaaatacaaatggtatttgaaggaaggacagtcattcatgacacaggtctgctacagcattggattccgcatcctgcagcaaaagccaggttgggaccatggttgggatgagattccatgggaacaagccaggagtgaacaactgcagttagagtggaaaacgtgtgctggtttgtctgggactttttctgtgtgagcactcaaagtctcatgtcctgggaaaatcctctgttctaagccaactgggagagttggtcaccttctttccagccagagctctgtctaaagttacatctgatggagaaattgagggatcacactggaaaaagtgaacccagagatttactttgaagctcctctgggtatgaggtcagtgtgggataattgtcatggacgaagattcactagaagtctcacaagccctgccaccctaaatcacatcagaaaagaacccctatgcattttcttttcataccacccaacatcctaaaaccatcagcttagtgttttcactcccattccctataaactccatgtggtttgttcacatgtcaggtttattcgtcagtgtatctttagcacatgtaaatggctgtcacaaatgcttaaatgattcagtgaatgattgaatgattcaatgaatgatcccatccatcaaccgttgctccaggcttcttgtaaagaccaggatcctgacccatggacatttttgaggctttaagccacagcccttcgagcaagggctggaaggaagcctctttcatctttctctggggctatcacaaccagcatatgtgtatttaattagtcactgcctatttttatatgttacacaagctcagtttctccctctctgttctctttttctcaatagtggcaatgtagattttttaaagtttatttttcagtttcttcccttttcctgcagtctccctctagagatgacactgactttaaactttgacccactaagatgcctctttagtttctatccaacgacttcatatatatctatctctaggctatccacaaaatggagatgtgtgattcatgcttttcatgcctttgggaatggacatcttgttcatagcagaggtgatacaggagtattaattaccaatgcttagtaagtattgatacccaggtgatttacacaaatcatcacaagaccacaatcatcacaagactacagtctacctcttgtataaatgcaacccaaaaatcttgaattataaacttacttgcttccttggacttcagataaatctctagtatcctcaagagtctttgaatactttcctgtctccagcaaatctcgtgggaaggaaaaaaatagatatcactttgcaatttatgtttttaccagcatgcaattgagtagattcaattgactccaaatgttttgcacattctaatttctgtcccctattgtcctcccctgttgacttcaagttaatgcataatatgatatgggacatccctcataaattccgtatcatcagagtaatgtggctttgatgatgtactgcattttaaattagctctgtcacaaaaggacgatggggggcccaggaggttttttttttctttctaattttccttctgttcttgaagtgtgataagtctaattatagttggcagcaaacagaagtgtttcttcagctagtatggcttgtgagggttcttggattgctatgatatcttcagatttttatagtaggtgtcttagacccaacaagtcaagatggcttctaagtggaaaggttttaaaagattaaagagagattaacaatacaagaagttagtaacattgatctgtcatggccaagttcagtggtgcattcctgtggcttattttactcatgggaattaaataatgataacattttcagaatcttagaataatttggagaagaggatatgacatatctaaattatgtgtatacaaagtaatttttgtttcttctaatactctactagtctaaggggattccttcctatccattgtcttttctggggaaagaaaccaaatgtacagtcctacgtacggtaggaagaatagctatagctcctctcagctctggtataggaaacatgctctaatgaattttccttccagcgttccataccagtgtttctcaagcttttagtgagcacagggatctttccaggaatcttcctacaatgcatattctgtttcgtaggtctgggtggagcctgagattcggcacttctaataagcttccaggtgttgttcctgatgccggttcgtgcaccagaatatgaacagcaatattttatagggtgttaagcaacagaaatgtatttgtacgtggatgtctctgcaatagaattgcatccagaggagaaatgaaatagcttacaattatggatgaattgtgtaggtattcatatagaatagctaacataaatggagccatgcgtgtattatttaacactcacaacagtatagatagacacagtgcttatctccatgacagagttgaggggctataagcttacagatgtttagtgatgtgatcgagttgctgagctaacactcagtggagtttgaacccaggcagtatgatttcagagaccacgctgaagtatctgtactgctcatggactgttgccctgaaatgcagtttatttgtctgaagtgtaatgtctggagttttttgcatcttcatcattataaacctcttacaaatattaattgagttccttaggccattccttaaggttttatagcagataagagaagataatgtggttccaactgaagaccaccaaatagtgctcactggtagctgaaattcaggaaatgatttacatatccagcaggagtgattttctttatatatagaaaaatatatttaaattgagttaaatcattatctgtagtaattatagctgaatggaagaaccggcctaaagagcaagatttttttttttaataaaaaggatatcctaggaactctacagtgatttgcagattaattctatctttgtttatatttctactttcaaacttttttattcaggtaaaattcacataatataaaatacagatacataatataaaattatataaatataaaattatgtgaattgtaaactgtacaattcaaggacattagattcacaatgctgtgcaatgattacctccaataagcatgtggaaatatgctcaacaccattagtcattagagaaatgcaaatcaggccaggcatggaggctcatacctgtaatcccagtacttgggaggccaaggcaggaagagtccttgaacacaagagttttataccagcctgggcagcacagggagacctcatctctacagaaaataaaaataaattagctgagtgtggtggcacacatctgtggtcccagctacttgggtggctgaggtgggaggatcacttgagcctgtgaggccgaggctgcagtgagtggtgattgcgctactgcactctagcctgggcaacagagcaaatctgtatctcaaaacaaaaaagcaaaaaatgcatatgaaaatcatgaggagacatcatgccacacccactaggatgacaagtaataataatagtaataacagaaggtaacaaatgttgtccaggctgtggagaaactgaaattctcaaatattgctggttggattgcagaatggcacacctgctgtagaaaacggtttgggagttaaaccaaggtaaacacagaattctcactaacttttgacgactgaatgtgtttgcctttttccagctgttggttgttttttttcatggcttcttccagggcctctgtcttgtttgctaatatgcggttctttgtcctgtatccattcagtagccaatgtaaaatggtgccaaacttactattttagattgaagggattagctcctctttccagtgattttaccattgtctgttcttagctggtgccaggttggaaagggaagagttgttggctggtttgttggtgtttttacctccaggtactgtgtcattccaatgttatttttactgtctcatgtggagtgtcctatatgatttgaataaaagtcccactccattgctgtctctgcaaggctgactcctttgaccctggcagaaagaacagttgatgatatttggtgaaaaaaaaaaagaaaatttgcccatggtatgactgttcttctccttggcgggaaacttctacttgaatcattgtgcagtatgatggaggcacttataggtttaaaccctaattatgccacttggtagtgtgtataagcatgggcaggtccttcaatttccttgtgcctctgttttcccaaataaatcatggaatagtacttacagaaatggctaatgattaaataagataatgcaggaaagcatttagcgtagcatctggcacacagcagcactccacatcaacgctggctgttattgtattattatcatggttacttctgtcctagtttttactctattacatagtttgggtctatttgcacaatatacttctttaaaacacacacgtacagtcaggtgcagtggctcacacctataatcccagcacattgggaggctgaggcaggcagatcacctaaggtcgggagttcaagaccagcctgccctacatggtggaaccccatctctactaaaaatacaaaaattagccatgcctggtggccagcacctgtagtcccagctccacgggaggctgaggcaggagaattgcttgaacctgggaaatggaggttgcagtgagctgagatcgtgccactgcactccagcctaggcggcagactgaggctgcatctcaaaacacagacacacacacacacacacacacacacacacagactttagaattatctcattgtcttcctacaagctgtctttttgcttctgcatgaacttttaaaccttctccaccaaggcaaggtaactttaaatggttttccccacagatagccagccaatgaaaaaattaccaatgtcttaacagaaaggaactttgttactttcaggtatacacagcaaccctgcagttcaacagtctctgtcctgggtagggcctcacgtgacttgactttgatgaaatagagaagcaggctgccctctgtcagttgaagaacccatgtttttagcataatgacctgattctgtatgtggcttggggaatcctatttgtgaatctgaggtctatctttatgttaatgattcttcattactttaacattcttgaaagtaggttttggccttagaatttgtgcaattctccctcaattgttctttattcgtagatagccatcatataagctggctggctgtaaaaaaaaaaaactcaactcaggcctagcgtggtggctcacacttgtaatcccagcactttgggaggctgagctgggtgggttacaaggtcaggagatcgagactatcctggccaacatggtaaaaccccatctctactaaaaatacaaaaattagccaggtgtggtggcatgcgcatgtagtcctagctactcaggaggctgaggcaggaaaatcgcttgaacctgggaggccgaggttgcagtgagccgagattgcaccactgtactccagtctgggcaacagagcgagactctgtctcaaaaaaaaaaaaaaaaaaaaaaaaaaacctcaagtcagtctctgtacagacgtttcaagaatgcctaatctgtggtgtctgtgttgacaaattcttatacaatgctttaaacatattcagattttaaattttattaacttacctaattattcacttaaagtaactctttaaaaagactggcttatcttactctagctgtacttttttttgctagtgaaactaccagtggattactttatctcagattgtattcatcatatttctccattataaatccgttaaaatgtcgtttctctgacttcttggagttgaggtctgggattatctgctatcagaggaaattcctgccagaaccccctagacatttccacattgcaaagcagcacgaagagcaagcatgagtgaatcaagttcttatataaagagggatcctaggataatgctacttttagagatggaaaagctctaagatatttccaagtaaaagaaacctgtgtttcagagagggaaaataacctgagtgttcacagtgagttggtagtaggacacagatgagaactctttcattctatgcggtaatggctctaggtcctcctgtcttaggctctgaagggagacagactgtagtctctcctggaatagcccgggaaggaactttgacatgaagatattcaacctcccaatggtagaaataggtgactctggcattcattcattcatgtaacaagtatttatggagcacttacccaatgccagacactgttctaaacagaggttatggcagtgagcagcactggacagttccctgctcacatggagttggtcacagtgcagggatcagacagtgaataggtaagtcagtgatctgccgagaaagatgacaacagtgtcacatcagggtgacgtagtagtacctgagatagggcatagtgaatggaatattttttctaagcgcaatggaaagtcactgtagagttttaaatagaggagggataggatatgacttatgttttaaaaatctcagtgacacctaggtggaaatttaattgtaggaagagcaagaatatcaattctgggcaaatgctgtaggtcagagatgatggtagctgctaagatagtagctgtgggcaggagctaatgatagaggaaggatactggacataaatatgaggactagaccctagacttagtggaagaggtgagcgaaaaagacttacaaacaactttaatggttcagcttgagcatctgaacagattaacccaaagagtttacatcaggctctgtgcagcaggtagtgttcactgctttagtgttcattgatttacatctccccctttttttttttaattaaagagattaggtctcactctgtcacccttgctggagtgcagtagaatgatcatagctcactgcagcctcaaacctcccatctcagcctcccgagtagctgggactacaggtgtgcaccatcacacagagataacttttttttctttagagacaggctattgctatgttgcccagcctcgtctcaaactcctggcctcaagtgatcttcctgcgtctgcctctcaaagtgctgggattacaggtgtgagctactttgccccaccaacatctattttaaaaataatcttgagatctataagccattcctgaccagaggtcagatacttatctgtttcttttctctttcttgagtagcacctcacacagggctggattgtggggtgttctaaatgcaggggtgaggcaggtgtactggagggttttaccccatgtgtgctttcctctgagctcaacaactgcagctaagaaaggtgtctcagtggataatcgcatgatccactgccctgtgtgggaccatagtcttttttttttttttttttttttttgagcaggagtcttgctctgtcacccaggctggagtgcagtggccttttctcggctcactgcaagctccgcctcctgggttcacgccattctcctgcctcagcctggcaagtagctgggaccacaggcgcccgccaccatgcctggcggctaattttttgtatttttagtagagacggggtttcactgtgttagccaggatggtgttgatctcctgacctcgtgatctgcctgcctcggcccccagaagtgctgggattacaggtgtgaaccactgcgcccggccgggaccacagtcttaagacgctggctctgccttcctgggtgccacagttaccatcttttgtaagtctgtaaacttcattggcctggcattgacttcctctgggtacattagtggggaccacaccgtgctgagtcacagttagaaggggcgtctgtcttcacagtgcggcatcactcttatcctggatgccctactctttatcattcctcctcctctcactctccctccccagggccacactatcgtttggcagtaatcacatccaagccaattttgatcaatagttttgttcatttcaaatggaaataagctccgtgtttagcagataaggagagttacactcaaaatgtggcacatttgtaccccatcccttaggtggaacatggcaggattcttcaggagggaagaggatgcactaggcttaatgtttaacattctttggatggcgtctcctccatgccaccgttagctgtgagctcagcaactctgggaattggaacagttgcccctccttgagactctttactgcttgtgacttgacacaatggaagggcagatttccactgagtctctactcggtggcttctcaaagacttccactgagactctgcgcacctttattgggttggcctgattcaagcctgcttgcagaggcattttctttcttgactctgacatgtggctcagtttgggaacccacttgttccctctctgagatctttccgcctgcattttgggctttgcgctttttataccttactgtggctccaagaaggcctttactgctgctttgggttgttttgctgttgttttgttttccacttagatgccctcccggtctggaagatttttgcctggttggaaagaggcaccttggcaggggaggagagaggagaacctacgggattatgtggaagtctttccccgaggttcacaccgaagcatcttagaagggttagaatctctttctaaacacttagtaagacacgttttctgaagtgtcactacagagtctaccctggcagaagaagccacatctttccagatacacctgcatgaaaaaaaccaaaagaagaagaaggggaacccaggaaggataacacgagatagaaaggccatcttggcatttggggaataaaaagtataagggcattttgcttttaaatctaagaaaggtataaagaggagaaatgttgaaaagcaccttgtctctggtttcttatgtttgccaaatattagcaagtacctgagatgctcttctaggtgtctgtcttgtgtgccatctggcccatgagctgtttgagatgggagagtatcttatctgtctttgcatccccagcaccagtagattgaaccgagtaacttccacggtgctcatcccaggggcaacaggccctgttgaacaggcattcactttatggtacttggaccacacttggtggggaaagaggtacttcttggccaccacaggtgtggttgcaagaaattagcctcataactttgaatggattcaaatcaagcatatctagagcatagcagaagtgtcatcaatggtggaaaaccaccttttcccctcttgcaatctgaggaacacctggcaaacatttccacctaaattagttcttggcttcactggtccagcttagttgaacggatgttctgggaggcactgtaatttcctgttttgtaggatctcataggaaatttttcatgtgaattcaactctgatctcttcattattgattatatgcaactcttggtattgttttctcttagcattcgatcgtattgattcaaatgctgttttcattaacttcatgggtgcatataagagactggatggatttgaggatcataacttcagtttcgctgactgcgtatccaccccatactaactgtgggactctatataagtttgtcttttcaaacctcagtttccttgtttgtcacatggagatgataacactcctctctcaaagatattgtgaaaattgaatgatgctgagcacgtagattagtcagcgaagggtacccacgaccagtgatattatgatggggcttgatccaagttggaatccgttacctttgcccagtaccattgtttgcacatgtctgctttttatgattattagttaagagtttattttcttacagaggattaggcaaagggtgattaagcataggttattcagtttaaactaataaatcttttttttataggctgaccatctgtcagggaagtggcagaaggcattccaataggactgagttgaattaaattgggagataaaagtaataacaatggctttcctccaaatgatatctaaaaatccgcgtactttttccctagcgccatttttgccactttaatccaaactacccgcatctggactacaagcctcctaactggtctccctcttttccttgccttcagatccaatctttttgtaataggttgatccttttaatattcaaaacaggttacctttccccatcttttccccctcctggccttcaataaaaacccaaacgtaaaataaaaacggataacttggcctgtaatcccagtttcatctggcctcttgcctttctctccaacccctctctctctttctctccaggccatcattcttagggctttcaacaccctgtcctccatgtcatttctgttgcagccttggagacgtgtgcctctccttctgccagaggatgcctcctgtcgtggtcacttggcaaggtccactcttatgtcacatctcggtttagactctgcagaaacgcaattcccaacccctccgataactactctccaccccaaagatctcactgtactaattgcagatttattgatgtggtgcttgttaagttactcaccatggtgtccccagaacccatgttagtggcattgctgaataaaaggtgcttcaaactacgaagggcttataatgtgcattttcccacttgaggctgatggcatctttgtgaggaaggcatatagtggacagcctcaaagctataggagagtaatctaaagcccactctggtgaaaacttggaaatgttaagaatagggtttgaatcccaggtgtctgatgccaggcctaaagctctttcaacttgagtactgcacgtgctagatagtctctgtgtactgttgtctaaaacagggatttgcaatcttttggcttctctgggccactttggaagaagaagaattgtcttgggctctaaataaaatacacaaacactaacaatagctgatgaactattaaaaaatcacagaaaaagattataatgttttaagaaagtttatgaatttgtgttaggctacattcaaaggcatcttgggccacatgtgacctgtgggccatgggttggacaagcttggcctaaaaacgtattgtttgtctaggtagggtcatgattcatgaagctattgagcaagcattttcatggcactcatatcgcctgtcagactttgtcccaagtgcattgtaagctcttccttgcctaatctgcacaaagaccttgtaagatagggtattagttagtatcacaaactgggtggctaaaaatgacagacatttattgcctcaccattctgggccaaggagcccaaagtcagggtgtcagctgggtcatgctccctctgaaacctgtaagggaattctgccttgcttcttttgactcctggagtaatggcactctctggcatattgtgattggcagctccatagcacctctgtctgcttctactttcatgtggcattctccctggctcttttcacatcatcttccttctgtctgtgtctgtctttgtgtccacatttctccttcttataaggacacatccaccttactgacctcatcttaatttgattcctttctgtagattctttttgcaaacaaggtcacattaccaggtacctgaggttaagggtttatctgtctttttgaggggacatgatttaacccctagcggatacatatcctattccattttcacaaatggggtcataggctccataataggaccaaagattctgagcttgccattggcaatgacaagttcaaacacagatcatgcctccgaagtccatgcttggtttgtggaccacacagttttcaaacccttaaatcaaagtgtggtccgtagattcaattaactttcaaaaagtgaagtagggctctttttcttgactcaaagtgagcttagccaggagaggcagatttttaaagtgcctgagcatgcgtattattactagctttgcctgctgaagcagaaatgtgttcttcccctgcccaactctattgcattgagaataaagtatctggcgctcttttactaagatgcaagccattcttcattttaattggtggggaaacgtttattataaaatgctcttcccccagaatagttccctaaagtggcatatagtatctgttttttcttcctcctctttcttcctgggaatcattaccagccccggctggtgatttataatcacattcccaacaaatttcactgttgttaatgactacttattttctatacaaatgatttttgctctccttcctgaggataattaactaagaaactggtaataaattactgataatgatcagtttgtcagagatgattgtcgaatggtgccatcttccatagtaactagataaagtatctttaattgctgataacagaacagacaaattgtggttcttttttttgttgttgttgttattgagatattcatgaaatcttcctcctggaagtcaggcagaataacaccttttttctctgtctcctgagggaggggaaaaggaagaaacagtcatgacttacagacttctagaaatatagtaaatgtgatcgctttttgaggtttgtaataagatagctgatctttgtaaagcagagatcagagaaaatctactctgggatacatttcgtttagaccaggggtccttcctggtcatgtgtgatttttttttttctctcaaaatgtcatctttcctatttgcatctaaaccttggccttcaaatgtgacttctttgaactctggaaaggaatagtatttaattcacagtgtttctcacggttaggatgctgactaaaccccagactgcaagcgaggctgtgaaagacccttagctgggaaacgtagagaagacctatgacaatggatgtacactgaaagtcctttaatcatagcccttattatctattttcttattgacaagctcagactattcatcgtagtaagaattgcaggacctactattaacttcagttctttgaaggatacacatatttcacatactgaaggctggtttacatttaatccagttaaatgtgtcactttactgacatgccttgaatattgtgagtcttgggtattgccatcctttatttataatctccatcagtcttgtaaacttttgttttgttttgctagatgtcagcaactgtcaaaaaagctatagtgtccgagatcatttgaatcattttggcagtttagaaaacagagtggtgcttaaaagaatagaaatgagaattccaaaggcggaggtctcaatatcaaattgttggggggtatgtagtgtctctttgggctttttaggttttgttatgagaagggaaggcacaaccagcatagaattagaatgtacaaggttacaaggatgtttacacactgatttcttcagaatttcttcagttccaagtgaaaaaagaaatttttttaagtttcaagtaagctctccaggtagtcacagggatgacaaagatacaaataaaacacgaataaactttcaaataagctgaaggaaaaaagaattaaattatagaactgggaagcacacggggtagacttcaggcgcggttgagtcagaagatttcacgatgtcgcaagaactctgattctctcagatctgcttcctctcttggtaccaggcatcgttaggtttcttccacacgtagtcttcgagaagttagcatccttggctgggtgcagtggcttgcgcctgtaatcctagcactttgggaggccaaggtgtgtggatcacttgaggtcaggagttggagaccagcctggccaacatggcgaaaccccatctctactaaaagtacaaaaattagctgggcatggtggcggcgcctgtaatcccaggtactcaagtggctgaggcaggagattcacttgaaccctggaggtggaggttgcagtgagctgagatcatgccactgcactccagcctgggcaacagagcaagactctgtccccaaaaaagggaggagggaagaggaggcggggaggaaagagaaggaagaggggaggaaggaggaggaggagggaaggaggagggggggggaaggaggaggaggggaggtgggaggaggaggaggggaaaagggaggaggaggggaggagggaggaagaggggaggagggagtaggaggagggaggaggaggagaggagggaggaggaggagggaggagtaggagggaggagggaaaaggaggaggggaggagggaggaggaggggtggaggaggaggggaggagggaaggaggaggaggggaaaaaggaggggacgagggagggaggaggaggagggaggaggaggaggaggggaggagggaggaggaggagggaggagggaaaaggaagtggggaggagggaggaggaggggaagaggaagaggaggaggggaagaggaggaggagaggagggaggaggaggaggggaggaggaggatgggaggaggggaggaagggaggaaggaggaggaaagcattcacttgaagatactgcagcaaattgtagggaaggctttgattggctaatttgagtcatgtgcctacttctgagcaaatccctagacgatagggctggagtcttctgagtggctggtctccagcctcatgacctacagagtaaggtaagaatgaggggaatacagctctgactaaatgaaataggcagatgtagaatggggcaagggtggttttccaaagtaaaagattttaggtcgatcctaaaacaaaaggaaacacaagcacacagtagtagagagaccttctcatggacccttacgtactttgactactacccagctcagtttgctctgcttaccagttcacagatgctttctttggctggctttgcttttacagtggattttctgacactttttgaacattgtctaagaggggtgacagtttcaaatccacccaagaagtggacaccattccatactttatgactgaatctaaaatgctgttcacttgtgcctccagctgaaacatttttctcttcgctctgtttggagtccctctccctcccctctctctatctctcactgttcttcatggtacacttcttttttgggggttggcggggggacagagtcttactctgtcgcccagactggagtgtagtggcgtgatctcagctcactgcaacctccgcctcccaggttcaacaattctcttgcctcaaccttccaaacagctgggtctacaggtgtgtgccaccaggcccagctaatttttatattttcattacagacaagccttcaccatgttgaccaggctggtctccagttcatggcctccaattcgtggcctcaagtgatctgttcacctaggcctcccaaagtgctgggattataggcgtctgccaccatgcccacctaattttcgtgttttcagtagagacggggtttcatgatgttgaccaagctggtgttggactcctgacctcaagtgatgcacctgcctcagcctcccaaagtgctgggattacaggcatgtgccactgtgcccagccttcatggcacacttctaattctttccttcttcatgagctttttccagcatgagccaaaatcaatttcttcttctgcatccccactgaaattgttatacttcataaaatactttgtacctacttcagttttagtttctaagaatttatgtctttcttgagaaacagagtactgttttgtgattcttgcttcggcacttcacattgattagaacaatgcctggccctaaatagatatttaattctggtgagttcttcccagacaagtctaaaggagggtgtgaatactcgggcaactcaagttatcatcatttgggtctggctgtgttcacttatgggaatacaagtgtgggcattaatagtttggaggagcacaggagaacagtgagctgactgcagaggaggagatggattttgtttctcttgggggccccaggaattttgcctcctggacccattttatgtgataatggctctgcgttttgggttacagagctcaactctctgagattaacacaaagcaaagggcttccctgtatgtctatatagatctagcccaactcaggataagcagcttctcactaattcagcaaatgttgtgtagcatcagctatgtgttggacacatgtaatgagtaaatacatatgtgactgctgccctcatggttggagctttgctactgggatggtctagtctggggctgcctcttattaccagcggcatctcagactagttattcaacaactgtgtgcctaaattttcctgcctgtaaaatgggaataaagagatacttcacagagctattgtgaaaactaaaggatcgtataattttacgctgtctaacataagtaaccatttagcaaatgacagctattacttgtagctattggctcatgaagtctgcaggctggtagcacacacattcatcaagtgataatatttaaaatgtaaattatgacataattgatctgaaggggaggtgcttggtgttaagaacacttaaaataaggaattctgtaaaagcttgcctgggaatgtgtagctaatatagctacagataagactattaaaagattagagccaaaatgaataatgtatccatgtctgatgattgataataaggcagcagttgtggacagctgagatggtccttttccaaccgggacgtcagagctactgtgattatcatgccaattacatctcacattctgccaaggtggttcttctctctcagtgcgttggtcatttcagagtgggaaaagccttcagctcagtgtccttcaggatccagtctactctttaaatttttgagagttatttggatttcagaaggatttgcctctcatcttctagtcatatcccattaccagtcaattcagaacatctattagttcagcaggagaggaaaggatgaatttccatgcctcccacctttgcttggtaacaggttatgcttttagaaatcacttcatgacctactgcttcctgctgggacaataatgttcttgtgtgtggctaagctatgcccacatttttaaaagttggaacacatctagtaaatatacatacctttgaaagtcctcatttaagctgaattagaccagtgaatagagtaataatgaaagtatttgaaggagggcaaccccttttctttaaaaggaaagagaataactaatatcaggaaaccaatcataccagtgaatcagagcccagttttggggactgaaagactcagggtgaaattgctgtgactccttgggctagtctctgtagttctcagaaactcagtaatgtcatctgtaaaatggaataataatgcccaattcatgtgtttgtagtgaagattgaaggagatactacctgcaaagtattcagatgtttgcctggtctatggtaattgccgaataaatgttacctgttatcccagtgttgtgtgcattgatggcaatgataaacaacaatacttgaggaattttgaggtttgattcatcattcttttaccttctgaaatttggcatccttggaaaatggaaaaagaaacaaaatttgtatattccttttgttgcagaaatgggtaattatgtgatatacacatacatatgtgtgtacattttataccaaaaattatatagaaaatgtacacacatataaatacacatacaattatatgtggtatgtatgaatgtattatgtgtaagatatatattataaatatataatatagagtatgtctggcagtatattctgttttgtgttatacataatataacaaaatgtatgttattagattacatagatttctggtatctatgttacaatcttttctaattaaaaattttttaaaaagtatctaaagaaaaagcatcagctgccccctgcaagttctctgaggactggcttttattattatttgttttgacacttcagtggcagcaacttccagttacagccagagtctcagtatgtaatcccgtggaaacgtccctaggtaacaggatgtgcccactggtcatggaagtcagttctgttaaacagggaggattttatctgtctgaataaatatttctgcagctcttctcacgctatggatttgagatgtgaacaggcaagaagggtcatcactataaatcaatagtttccatgaagttgccaccgatttagagcagacagcagcttttgggttgaaataaagatcgtgaagtgcagacgtaggcagcaaatgctggggataatgtgtggagtgtataggactattcagtgaacgtctatcaaggatggatagaaaggagaatgctctttttgagataagttagctaatcgataattggcaagggaaacatggaaatacttggtggaaattgatgccacctacaccaatccacacaagtacatgcacctcaaacctaccacccaatatccaattgtcaccaagtctatctaatcacatcttactcacctttgtgctactcacaagttgccatggaggtgagagtagacgcggtggggatggacgatctctctcaggacaggatgatagaaaaggaagaaaagaagatttgttttaaggatgggccacttctatgaatggttggaagaatggaggagagaaggacagcaaaaggtgataggagaggtggcaggtgaaccagggagggacagtttcctaaagggtagaaggaatttcatggagacagcaacccgtggatggtgccaaatctcatcatgaattgacaagagtccttggacttaccttcctgggagtcggttttatagattttgcacaactttgtacctaaatcattcccaacaattaagtgtgagttcccagagggcaggtaccagggtttattcattttggaaaccccagggtctggcagacatattagggatgaataaatgtgttttgaaagtatgaatgaatgaatgaatggataaataagtgctggccttaacataacagtttaatgtctgtgcaaaatgaaaataacaaagtgttaaagaagtaattagaaattggcaaaatggggcacaagaaaccatcttacatatgtggtagctctaggggtttaagaaataacatccctttatttccctactgagtaagaaccaatggagaaagaagctgggcaggaaggcaaaaggaaataaacaatcttctttcatttagcctaatgtttttaaggttctgctcccatccccgtgaagtgttgggaataggcaagtctatagagatgcgaagtagattagtaattgcctagggatggagcgtggactgcaaatgtgcacgaggcttccctcccggggtaataaaaaaaaagttctaaaattaaattgtggtgataatggcaccactgtgtgaatatactgaaagctactgaatcgtgtaccctgaattagtgaattttatggtttatgaactctatctcaataaaactggttttctaaacaagaaaacaaaaaggtttccgcttattaaataaacccaaatttaaaggtatggccgaatgggcttgcttgtactctcctgatttgtgcagacttgtccatcagtcactgaaagtgtggaaatcttcagtccatcctctggcctccagtagacacagacacacacacacacacacacacacacacacacagacacacacacaaaggtacacagacacacacacagacacacacagataaacacacagacacacagacacacacagactctccctctcactctcgctctgtcgctctctctctcactcatgagtgctgtagctgagaaagaagcccagagtatgctttttctgccagctggagaatttgacctagggctaagtgactagcctgagtacatccaggttcttttcccaaaggaaccaatttgataaaccattccttcttagcatggaggaatgagaagctggggagaggcccagaatattatgctagaaaaattcttgcacatggaaacacagggaaggaggataagggggtgcctccattcttatgtctcatactttttatgtccagtagtgtctgcatttctatcataaatactcttttaaaatcaggagtcctagaccagagaatgttccctgcattccatatcaggtaagatccaagtatacaaagcctgtctctttaattaatttcctttcacccaaatcctatccattgggcatgatcaatagttataaaacccatcatttccagtgttatggtaatgcgaaagcttgatgaaatatgggtttgaccacacagtagtcagaagtctagttcttcatgtattaaaggataccattccagctgggcacggtggctcacacctgtaatcccagcactttgggaggcggagacaggcggatcacgaggtcaggagatcgagaccatcctggctaacacagtgaaaccccgtctctactaaaaaatacaaaaaattagccgggcgtggtggcgggcgcctgtagtcccagctactcaggaggctgaggcaggagaatggcgtgaatccgggaggcagagcttgccgtgagccaagatcatgccactgcactccagcctgggcgacagagctagactctgtctgaaaaaaaaacaaaacaaaacaaacaaacaaaaaagatatcattccatctattgtgtgtttatctctgtttagttacgcacttgtgtgtagttgcattgacatttaggcagacttgcctattctagacattttcttactatgaaatgcacgtgactagcacagtgtctggttattagtcaattctcattaaatattggctgcataagggatggggatcataggcattcggaatataggaggatcgactctattctggcattattggatgaaaggggttctttattggaaccgactacatttttttgtccttggtaatattagtcttactttgaggcactagggcattttgagactagtgaaactcccatggccttcagaattataatttaaatcttctattcctccagaactcaggacatttaatttatcatgattcataaaagaccagtaataaaccctgtctttatttaaacgtgggcggcattgacttcccgctgtaggaattgggtgttctttatcaacgtctctctatctacttatcacggatcctgcatgtgtacaaaaaggcatctttgtcagtcagggggagattttattaactaaaggttcatttgttcttcaagtgacactatctctttggaattaccagatgttgttcaaactgtgccggctctccttttattctgatgatggcaaatgttgaatgtggtgaataaatattgggcactgtcctcggtcatctcaaataaatgtgataaaatgaaaacatgtcgcctctgaggtctcatttgttcccaggaagtccacggcgcattaaggcccacagacaatgaaagacgaatcagccattcactgggtattccattatgagacattcttgtcattttccagattgaattttagattaatatatagcctgagataagatggcatgtattgagatgatgccacagtgccatggccaaattgttttgttataatcacatgatatagagaattaaatgtattgtgatgatctgccgtagaaatttgcatttaaaagaaaaagtggcagaaaataaattaatagtaaatttcttatgacttagacctgaagaggctcatgtgactgcaggtgttatgttttgacccttctttgctaccatggcaagactggtgactgtcttctgaggagaagtagaggagatttcacttaactggatgatcacagagttgaggtttttgtcatccattgctgagccatgtattaaatattcattatatatataaatatacacacatacgtatatatacatacatatatatacatatatatacatatatatacatatatacacatatatatacatatatatacatatatacatacatatatacatatatacatacatatacatatatacatacatatatacatatatacatacatatacatatatacatatatacacacatatatatacacatatatatatatacatatatataataaaaaagtgggaaagaacaatctggcaaaacagacattttggaatcaccatgcccttctttttcgggtgatgcatgacacccatgaattaagatttaaaagaggatataaagcagaatcttgctttcacagtggggagaagaacttatgaatgctttgaaaataattgctaagaattatactcaaatcgtattacatcaagaaatggagatgtgaaccagactgggacagtacgatttcacaataacagccacaatttctctaatttattacattgtcatctgtcttgtgatttaacatcctttttcacagtctgcagtaatatatggaattactaaaagttggcggctgtctgacgttcagaaatgttgaaagaaatgaagtatttctgtgggtgttgccgaagtcctgttgaaagggtagttaagtatcgctgattaattcccattctatctctgatgaaatggagaaggggaaaatgctcctttcgaccaagtatctcattgcaaactgcagcccagaagttgcataagcattttccttcttcggtataaattgatttgctgtgaaaaatttcagacggttccatgtcaaggcaatgttttatttcgtggtgcaggacaaatgtagagctaagtagatttgtaggctaatttattggtcattttaatattgtgtattctcccctttggtgtgttaagtacttccccaatgcttcttcagcgatatactgcttatggcatgcccaactcatcttaattaaattctttcttgccacaacctcatttttgctcatgggatacattgctgtcactgtgaaacattttctaggaaaattgagatctatttttcataaattaggctcttttttaaggctctctatgttagtcacttaaattaatattaagttattatgtactccaaatcagtgctttataagtctttcaaaaaatatcggttgcccagaagcctgggaggagtgcgatagagctggagcgtaacgtgcaggtgtgttgggttagtgatgggtgaaatgactctatgtggctcgtccccacctcccattgttagaggcaatcagagaaagcattttgcaaatcgagaataagaaagaggccttacagagcatgttgccgctgctgctgctgctcctggcacccctgctgagatcagctcagtgcagtcttctcttttagaaagaggagaagagtttatcctgaactgtgcattttttagttttagaaaacatggatttcctgacaggaaatgggaagctttttgaactgtatgacttgagtcatctgtcacgttggaaggacattggaaaaatcagcctcctgatgtagaactttgtcatgactttcaaaagtttccctacaaattgacacatggggcttttggcttttgtcctggggatatggcagttgtcatgtcaatgtctagaaaaattgtcccttataaccaaagatggctaattaaacaaaacaaaacgcccaaacaggtgcttattcattccctccgtccgtcccactctcacacaggtaaagaacgtgtttcagctaagatgattaacatgcttcccccacccccaccccctgacttaaatcctcaagcccactagctcttgccttaccgccatgctgacttttacttccccaaacatacccagctcctcctgagtgggacgttgtgagcattctgctccctctgtctggaatgtgcccctcctgcctcaccacaacctttgcagagttagcttttacttctcctttcactctctactcaaaaatgccgcttcctccaggaaagtctttcctggaattcccacccctaatgcaactccaactccctaggatagatgagaatatgtctgtatttggtctcatagttccttgtacttttcctccagtttatatatacatatgtgtgtgtgtgtgtgtgtgtgtatatacatatgtgtatatatatgactgtttgtgtgtacatatatatatacacaaacacacactcacatagtcacatgtcatgtcaatgtctagataagttgtgccttataaccaaaagtgtctaattagacaaaacacccaaacaggggtttattcattctctcagtctatttctctcacatatatttagaacatgtatatgtatgtgtgtatatgtgtgtatatatacacacacacgtatgtatacatatatagatatagatccacacacagctgctagtaccactgctgagatcatctcagcaccatcttctcttttagaaagaggagaagagtttatcctgaactatgcattttttgagaaaacatgaatttcatgttgaggaaatgggaagctttttgaactgtatgacttgagtcacctgtcgtgttggaaggacattggaaaataggacgtgtgggtgtatgtgtatatatatacatacatacatgtatacacacacacatatatgtgaatatatacccacacacacaaataagtacataggtatatatctgtgtatatatatccctctataatctgtgtgtgtctatatatctatatctctttatatccatatattgaacacctactatgtgccaggcgctcttcctgcatttggaacttgttggtgtaaagacgacaaactgaagttgttccctgaagctcccttatctgcctaaagtctggacccactaaaaaagaaaacaagaacctctggttccttccctgagttctcattaattgaactcatattgcaggaagaaagactgatgttttccaacccacatgaacagacttttgtcacaggccattgttcttcaagcccattgagttcccgtaaaaatcacttactacctatgctaaaatcatccacactttcccatttccctttcccctaagaagaaggatatataaccatctgtatcacattgtgcggtggggtaatcactctgttattctgccccatgcatggtaatcaattcgtttgccatttatcaaaaaaaaaaaaaaaaaaaagtcaagccctcatgaagtcaatattctagttggggggaaaaacaatgaaaagtgtgcgtgatgcctgagcaaattgtgttagaacatgagcagtgctatggaaaaaagaaaaccaaaacagaaaaggatgaggagggcaggagagtgggggtggaagaatccattgcaattttacatgaggaggagagggccagtgtgggccttactgtgaaggtgacattttggcataaagccagctgcatggatttggaagagcattccaggcagtgaaaacagtcaaagcaaaagatctaaggcttgagagtagccgtctgttcaagagacaatagaagggccagagggagtggagcggaaaatagcagggaatgagttgagggaagaagcaaggtgaggaggaggtgcaaaccacttaggacttgtaggcattcagggcctttggattttacttgagtaaaatagggtcttgacttacatttcaaatgaataatttgaacttctgcattgaaaattgattatgagggcgcttaatgcagtttatagctgtgtacttgtgtgattatgtggttgatgtctgtctctctcatagactgtaggccctaagagggctggagtactgtctgacttgctcttcatggaatctccaagatcaagcctagtgcttggcatgttgctgtccaataaatatttaatgtgaaaggataaaatgaatgcaggccacatcaagatgatgctagttggcattcatccctcagaggcatgtgctgtagatagtcaatgtgcaaatttcaacttgtatccatccacttaaagacaacttcaaacgcaccctccaaccacaggcttaagttgaattatctgcttaattgttgctatgtgcagctgtttttcattagtgctgttttaatttgcagtctatgaactttgatatttgtaacaaaaagtaattggatactagtctggaaggcttccctccttaaaatgaatatgcttcacgcccaagcaaatgactggaaaggttccctgctgtctactagggaaaagattcacgggggcaggggctgtccacagcagaccagaatgttacagtctgctgggtaaatgttccatggtttcagaattaatatgcatgcattccgtaatacatatttacctggtagtctgtaaccattcagtagaactgttacagtctagtaagtaaataacatgtttttcaaaattagaacgtgtaccaaatatgtatttacccaataggctgtaacagttctgaggaaaccttccctgttgttagtctatcaggctgacttatggatatgggtttaatgttgttttgaatatgaacacagtataaaggaagatgtgtgatttttagaagggcgaggggttgtcatgtagaacaaaccaattttaggaggaaaattcaattcagttgcagaatctgttcctgctattcttttcctttcttttattttatctttttgttttttcttttatgctagttgctggaagattgctaatgacaccaggatgaatttttaaatactgtaatttaattattggtaacataatatggctttataagtgattagtggacagatttctgaacatgtgtaggggccagttttttagttgctaacctcatggccttggaggaatccacaagttggattctggtgaatgatttaatgacggtattggcagcactttgcctaatgagtatgtatcactctggcctaggtaagtcaagctaaagctaaccacattcacatcatccacctagatctgttatacaggaacaaactgtgtagagatcattatgaggccatgttggtgctttaaggcatggagttttcagcgggatattactcatttccatcattactgatgttcagctgcatttctactgatgtcggctgcatgggtagagaattagactccatagttcaagatagttcatgggtaagtaacattgtagtcaagagtttgtggctctggaatcagatgacttgggtgccagccctctgaacttgtatcagtgatttaaccactttaagacctgattaccttatctgtacaattagagattgccttatctgcacactaattgtacagaacagtcattgtacagataaggcaacactagtattcactttataacattcttgtgagtgaaatagtatccataaactgtgtatcactcttcagagcacatattgaatatttaataggcatcatcaacttttgtctatgatcactgtggaaattcagctgtgctggcatacaggaggtatatgtagcaggattagcaagggtgactcagtccaggtttccaagtatttagtttggaagtaaatgaagacacgatgtgtgtaattggatatttcactaataggttataagtggttgtgcaagtttctaaacatcttgcatgtactaataaatacttttagttgacaaatgagaaagcagccatgaatctgagtctcttacttggaaccaggtgaaacagtgatttatgaaatgccctttaaaactccttggaggttcacattctgcacaagttgctttttttctttctaattgagaaagctgctatattttgagtctgtgtaagcaactgcaggccttgattcttgattcttttctttctttctttctttctttctttctttctttctttctttctttcttttttttttttttttttgcatagttgttactgtttccttgggcagagagccataggatgagtcccacagccctttcctgggtatgtccttctgtgcaatgtaccttccatgaagcttaccagcatgttttatcatgtgttcaatgtcatttgcacaattagactcagatgctgcaggggcagggggccatggagtatactcacttcttccaagtgctgtttccccaggcccaagtgcaatgcctggtgcaaaatgaatactcaggtggttcctgtgttgtcgtcctttgtgactctgtctctctgaattagttctagtccatggcactgcgtgacttccaagacaattttagcatcctgtgcaacacgcatgagatttagaagcattgtctgttgacattattctttatgaacatttactgagagcttacaatgggccaggcactattctaagcatttcacatcaatatttcataggaatccatttaagtccatcttattattaccctcatttatcagatgagaaactgggatcccccctagattggatgtgtataagttattgagatgtaagtcaaaaaatttggtgcatccctagagcccagagtcccttacatctactctaccttgtctcccaaggaaaatactatggtcaggagttgggtaagccgataaaaagatggctgggtgtggtggctcacgcctgtacttccagcactttgcgaggccaaggtaggcagattgtttgagctcaggggttcacgaccgttatcagcaacgtggcaaaagctcatctctacaaaaatacaaaaaaagtagccaagcatggtggcacacactggtagtagggcacacacatcagtagggcttgggaggtggaggttgcagtgagctgagactgagccactgcaatccagtctaggagacacagtgggatcctgtctccaaaaaaaaaatatatatatatgtgtgtgtgtgtgtgtatgtatgtatatgtatgtgtgtgtgtgtatatgtgcgtatatgtgtgtgtgtgtatatatatatatcccattaggtctgcctgccacagtggggatcattcttcaacatgagatttggaggggacagacatgtaaactacagcacccatgttgtttctgcttcttcccagcaagctatttctagccacccttcacctccaccaaccttaacctcacaatcacttctggatgttcttgtagcctacactgtggattgttctaggctctttaattttctgttttccacgaaagtctgtaagcttgatgaggataaaagccatgattgccttgcttaccctcactgtgaatgaatgaatggagtggtgcagaaactcaagagcatcatgtacatatggaacatgctctatggtttttaatgaaaatatgtggcagtattggctgggctgcagtgcatacagtggagtattattcagctataaaaagaaggaaatactgtgttcgtaaaaacatggtgtgaacccaggagacagagcttgcagtgagccgagatcgtgccactacactccagcctgggcaacagagtgagactctgtctcaaaaacaaacaaaaacaaacaaaaataaacaaacaaacacatgggtaaacctgggggacaccgtgctaagtgagataagccaggcacagaatgacaaataccgcatgatctcactgatatatggaatctaaaaagctgaactcttggaagcagagagtagaaaggtggttggcaaggtttgggggtgggggaaatggagagctgttggtcaaaacacacaaatttcagtaaaaagatgaacaggttctgaggatcttgttccccagtgtgggtggtgatggatgtgttaatttatttgattgcggtaatcattacacaaggcatatataaatcatcacattgtacaccttgaatctgttcagtccttatttaaaaattttttaaaattaaagcatttgcggctgggcacggtggctcatgtctgtaatcccagcactttgagaggctaaggtgggaggatcacttgaggtcaggagttggagatcagcttggccaacatggtgaaaccccatttgtactaaaaatacaaaaattagctggatgtgctggcatgcacttgtaatcctggggagactaaacaagaattgcttgaacccaggagacagaggttgtagtgagcagagattgcatcactgcactccagcctgggtggggagactctgtctccaaaaaaaaaaaaaaaaaagcatttgcaacagggaaggtaaactacagtgataacaaaatactactcattgtagaaaagacaaagtacaaatagccataggcccccaaatgtgaaatgactttttcttttcttttctttttttttgtctgagacagagtctcactctgttgcccaggctggagctcagtggcgcgatcttggctcactgcaacctccatctcccagattcaagctgattctcctgcctcagcctcccaagtagctggaactacaggcgcccgccaccatgcctggctaattttttgtatttttagtagagatggggtttcaccatgttagccaggatggtctcgatctcctgacctcgtgatccacctgcttcggcttcccaaagtgctcggattacaggtgtgagtcactgcgcccagctcccagattcaagccgattctcctgcctcagcctcccaagtagctggaactacaggagcctgctaccacgcctggctatttttttgtatttttagtagagacgggggtttcaccatgttagccaggatggtctcgatctcctgacctcgtgatccgcccgctttggctttccaaagtgctgggattacaggtgtgagtcactgcacccagctcactttttctttaatttttgctataagctcacctgatgaaaaaaagagctggaaggattagcagctatgtgaggctatcaatcagggtaagacaggctatgctgtagtaacacataacccccaatatccatggcttaaaagaaccaatgtgctttgtttttgtttttgtttttttcctcacatatttctctctgttcatcctgcactggctgggagtgctactctatttgttcttcatgcagggtcacaggttacacctcttctgcgattaccaggacagagaacaaacagagttaattgcacactgttccttcaaggtgttatcccaaagtaatgtgtgtcatcactgttcaaatttattagctaaaacaagacattcagctatgcctaagtccaagtaggcaaggaggtacaatcacctccgttgttttgaaggagaaacataattttttggtgaaaagcaactgagatccaccacggtgagaaaaagccacaggccagtctcacagcatcatggcgaacagctatgcctaattgcacctcgattctaggtgtgatcctgtcaaaagcagtacctttaagatgtgtagttatagtattgtcattctaaaatatgtaacttttaggaattttgtggctagacgtagggacctccatttgattttttttttcttctcttcttagtgagcctagtttgaaatgttggctttcttaatctacagagactttgtcattaatgtgtaatgaatatctggtttcaaaccataggctgcttatcccttgactatttgtcgagacctttgtttgccgaaatactgctttatttcatttcttattatctttagaaggtattactgataggtattcattttgacccctttacgcacactcctcaagtctgtcttctccacaggctaaatcagtattccatccacttttcatctttactgttcctggcactctcatctatatgagaaacaggatctgtgtttgacaagcatgcttaccctttgcttactgttttaataaaaatttctatcagcgtttttatctgcagtagcagtcgagacactgtttgatattgagatgctagatttcatggactttgaaatattttccccatatcttttttggcaagtctttgaacatagaccacaaaaaattgacatgttggagatgaatttacagactctaagttaactaatgactacctgtcccagcttaaattgtgttctaggattgaaacattatattacacagtcaaatcgttgaaattaatggtcagactcttccataactgagttagtttcccatgagactgatactctattaaatgagcaggctgtccagatttctctgcatcgcctttggtttggggataatgttgacccagtcttggcagtttcaaagcagtaccaagcagtcagactattttaaatggggaatgatgaatagcagcttcctaatctccaaatttcattcagatacggtatcttatttcatcccctttatcctgtgaggcaaattattattgtcctgaacacagagagatggggaaactgaggcatggatgttactctgtgtgctgaagattatacaactactgagtagctcaggttcgtttggtctttctgtccctagatagcctcttggctggcagttctcatgattcaggactcttctcaaatatctctcatgagagaggcctttcttggctgctccagccacagagacagtcaccctggttctctgctctgtcaccttcatagcacttattactatttcattgtgtttcttatgtgtctgcttgttctcagtctctgtccacttgagaacaaaggaaaggaccttgtctctttcatttcagcgccacatcccagcactacaccagtgcctggcacccagtagatattctgaaatgtcagtggatggatgcctatttacatactgtgcttttcttgtccctcagggccacatttttgagttggtccatacaaagcaacaaattaagcatttagggctttatggacaaaccccactatttttttaaaattttttaaaattcctttttagagacagggtctcactctgtcacccaggctggagtgagtggtgagattacagtttgctggagccttgaactgccaggctcaagcaatcttcccacctcagcctcccgagtagctgggactacaggcgcatgccaccatgccaggctaattatttaaattctttgtagaggtagggtctgactatgttgaacaggctggccttgaacttctggcctgaagtggtccactatttaaggtctttgacagtgcagctttacgggtaatgacatgtattagttatctaataccatgtaacaaattactcccaaagttagcctctcaaaacaacaaaagtttctttttcatctcatagagtttctgaggtccaggaatctgggagtggctctagctctagtttccttgtgaggtggtggttcagtacatcagctggggcagccgtcagtgacagttggaagtactgcttctagactcactcatatggatattggcaggcctcagttcttcaccacatgggcctctttacaggctgctggagtgtcctggagacatggcggatggctctctaccaaattgagttatgagacagagaaagcggggagagaaaagggagaaagaagggagagatgctaagatggaagccatagtcttttataacccaacctcagagtgacataccatcacttctgccatgttccattggaactcttgtacagtgtgggaggagatggcacaaaggcacgaataacagaagatggggattatctcagggccatcttgggggttcattctcatgtatcttattctgattctcagaagagagccctggatagaacatgtaactctgtataacagtaaatcatttcctaatgtcttcttccatttcaggggccagttgggtggaaagtttgattaccagtgtgcttataactcttttttttattattttttgagattgagtcttctctgacacccaggctggagtgcagtggcgcgatctcggctcactgcaacctccgcctcctgggtttaagcgattatcctgcctcagcactgcccccaagtagctgggagtacaggcacgtgccattatgcccacgtgatttttccatttttagtacagatgggatttcaccacattggccaggctggtctcaaactcccaaccttaaatgatctgcctacctcagcctcccacaatactgggattagagatagctcttggataatatgctacttaagaatacagattctggtgtcagcagcccagctttgaatactctctctgcctcttgatatccatgtaaactgaggatattttgaagcttttcttcttacagaattgtggaagcaatgtataagttatctaatactctgtattagttatctaatactgtgtaagaaattactcccaaagttagcctctcaaaacaacaaacatttctttttgttgaatgagttttcatctcattgctgtagaataggatcctagtagtatctacctcatggagttgtgaggattcagtaagttacttcatgtgatgctcataccagaatgtttgccagactaagggcacttaggaagtgttgacttttattctttggattatcccacagctaatcagtgccaaagtaattgttgcttcccatagcttatccttcactagatggaagtgtcctagacagacctctgagacgaagtcagtctaaacaacttctggcaagctatgagctgtaattgggttaaatagttgcgacgtggagaaatctacttttctgttgcagaagtttcatgggctctgtcaacctttctgtccatgggtggttttctgtgggaacccatcctgtgagtaccttgacaataacagcttacctaccatccagaatttagtattctcccttcattctctagagaaaacccaagcataccttcctgagtggttggccagtggctgaattccacggctgtttcgttaagttctctttaagcagatttttcaagtcttccctatttatatcttttgaaatccaatctccttcaatcaattttaatcccctaatgtgtttgctataagtactgtacaattcacttgtcctcaataataaaattcattttggtgcagcctgccggtaatttgtttgagaagaagtcgttaggaaacccttgcattctcttctggtttagaggacgaccttcagtattgatagcattttgttgtcatgcgcttgaagtattctttcatgattgacagtgccgtttaaataatggactacagagccatgtgcttaaatgaaatctgactacactaatttcgttatatattaggaaacttcaagtgttctacaaggacacgatttcattgaccatggatttatattttcagtttgtatgaattatacccattgtgtattgttcccccttcactgtaagatactcttttgttttgaaaatcagtgtttttgtgttttaactctcaatgtatgctgcataagcaaaggattgtgttccaggcccctcctggaacaggccaaagtaagtaaaatcgagaattttttatatgaaagatagaagaagtacagcattattgactcagcttaatactgagttaatacactctaataaggctcagaagatataaaagatccactgtactctctctatatatatatatacacacatacatacacatataaaatataatttatacatgtatgcttaattggaaaaaataaagatcaagagcatgttttattgtttatctgtatctctagctttttttaacagcatataaagacaaagcacctttttatttaggcttggctaaaaattatcagtcatatgtagatgattttgcagtatccgccaacttcctactcaggaaaagttatagcagatggcagaatttatgtgccatgtggcatttgtttaagtgtggaaatagctaatattttttcctcaattattataactattttacttttaaagactcaattaactttgaaataccattcttgatgggtgcctcagttaaggatgggatggggagaaggaagagaaatttgaaatcttgcagggcctttgattgaataacggttatattgctcattaatcagaggctctgggtaccctgttttcaaaataacattattgtttactaaatatagactcctgtggaactgttaaggagaaggtcctactgagatgagcaggcattgtggattggcctttctactaccaaggactgggattcacatttgcaagtttgtgggtcctcagggagaatatcttggagttgacatcatttcaggcatatagcccgtaatttgttttgacaactacaaacaaaaggggtctattcccaaaaggcttcttcgaaaattgtcagaggctcttgccgttgataatgtgagctgctgctcccagggctgagggcctgagaaccacagcaggactggaatccagtgggaggagcaaggaagctgcagggggtgacggtgggcatccttccagagagaagggcacatttgaaacctaggagaccattcctgtcaggaatcaatatcaggtgactgtgatctatggcagagacccagtgctcggagtgatttttttaagttgtgtatgcttcatatagattttctttcctgatttgagtttttctacttgggtgaaataaaaggcaaggggtttgtgtgctggggtagtcggggagagaggagaggatttgatggagaacatcaaggacctgttgcttgcctgttttctaggaatccttacctgtaatcagctcattacagagaatcttggggttctcttgagcctgctgaaggcatgcctcctgagatccattgaatagagcaaaaggatcagtcaggaaatatttattacacagaggaaagaagaatgcaccagcagagttctgggcctgctgcagccactcagtaaatattttttgagtgaattaatttatcaaaaaagcatatgtaaaaatatgagtcattatcatgagtggtttgattgaggatgatatttcttttcttagtttttacaactgttggtaacatttgattaattacttttattacaattatgattatcatcattttatatacagttgtactccttgcctgtgttaacaatttggtgatagcctttcacatttttatacctttacatggcctgtataagtatacagttttgtcctaatatacatgaaataataaaaagtggatttttctgccaatacacacttagcaagcgttccagggtctctttatgtattagaacataatctcattgtcatctcattctttttaaaacgttacttgatatcccgtcgtggaagtataatatttatttaaatatgttttgcctatatttgatttcataatgtatatttttaagtgacaaatctgtatcaaattctataggacatagagaataaacccatgactcttccaagttgtctgagatctagttatgaattttgcacattttcttaatgagtatgttctgcttttaaaacattaaaggttgaagaacgttttaaatctacttacaggatcaaaactatgcacatgaaaagaatgtctaacctttgttgggctcttatctaagagacactaagcgtgcatgtacaaatatatataaactcattaaaatcccttccattatttagcgtgaaccgtagcatagccaggcaagattgctgagtcttccccagatggac[133 bp omitted]ctcttgcctcagcctcccgagtagctagaattacaggtgtgagatatgcacccagctaattttttgtgtcttttagtagaaacggggtttcaccatgttggccacgctggcctcgaactcctgacctcaagtgatccacccaccttcgcctcccaaagtgttgggatttcaggagtgatcccgcatgcccagccatcaataaatacttactaagtgcctactttgttcccaagagtgctgggaacttagcagtgaacaaaataaataccttccctcggggaccttgaactcaagtctagtcagggatcactctattaagagatcaagtcaacactcaattctcctacagactcagataggatagtattttaatttctcgttgatctgctccctcagaccctagaccatgggcactgcagatttttgcaccttttgtagaggcagggtttcaccactaccagagactttaccatcatttctatgtgaagggaaacagtgccctttcagtagacaacgttaaatcagccatcagacgtgggtcatggtgggtttgccgtgactgccacaaacacgcctcaccgaagtctgccaggggacgccataccctcccctagaaagtaagaaacagagaaaggctttctcctgccccggactgtctttctctcagctctaagaaatttctttacagctgttactttatcctggcctgtctcttgagtaagaaaactgctggaaagagtctgccattcactcagatcataatcagggagcctgctgtcactcaggaagggctttaaaaaattcttctgatttactgtgagtgcaaatctctgatattcctgcatctccccatccatcttattttgattttacacatagtgcgattttgaaaggaagcggtgtttttggagaggtagaaaaactctggaaaataaggcttatgacgttggccatcagcacggggctgctgtctgctgtgtgacatgctcaggggtgacgcgcctcccgaaagagacacttggtagagaaggcacgggcgcgaagcccggctgcgggagagctgggagcctgaatgtcgctggctgccgttcacagcaggctctctctgagcaccgtggggaggcagtgacacccgctggcctcgcagcgacactccggcagctgtcctgttttccagcctggacgtgataggtgtgtcttggaggacagtcagaggaagacaggcaagccatactggcctccctcgaggttataccctcgcttaggttaggttgcttctaacagacatcctccgcgggcgttgaggcagccagcttcactgtcacccagacaatttttctctcgctctgccaaccctgttcccctttcaagaatgtttaaactcttcattcaagcgatgagagggaaacacttgagctgcacactcaaggagatgtgggtttccattctggccttgcgatatattattggtgggaccgtgggtgagtcacttaacttctctagtcctcagttttcttatctgtaaagtgggctccagcatacggcttaactgaggtaacacacgttgttcatgtcagctgttgctttcatgccggctctgcctaggtctccccatggcaacaggataggagttctctgcctgtgcgtcagtttttcactagcgtgggaatgctgtgaggagggggcggaactcggtgtagcaagggtttctgtccgtatcttctattttttttttttttttttttttgagactgagtcttgctctgtcgctcaggctggagtgcagtggcgcgatctccgctcactgcaagctccgcttccagggttcacgccattctcctgcctcagcctcccaagtagctgggactacaggcgcccgccaccaagcccagctaattttttgtatttttagtagagacggggtttcaccgttttagccgggatggtctcgatctcctgacctcgtgatccgcccgcctcggcctcccaaagtgctgggattacaggcgtgactaccgcgcccggcccgtatcttctattaagaaccagcaaccacgggctgggcgtggtggctcacgcctgtaatcccagcacttagggaggccaaagtgggcggatcacgaggtcaggcgatccagaccatcctggataacacggtgaaaccccgtctctactaaaaatacaaaaaatttggcaggcgtggtggcgggcgcctgtagtcccagctactcgggaggctgagggaggagaatggcgtgaacctgggaggcggagcttgcagtgagccgagatggcaccactgcactccagcttgggggacagagcgagactccgtctcaattaaaaaaaaaaaaaaaaaaaaacagcatccaggaatgctatcgtgtagttgctttgagacatggcctggggtctccccgcaaggcgacaggacagattacgacacgttgtttgaaatctgcctttagaaaaagacacggcctcattttatgcctgtgagtgatttttcttctgtgtcatatcataactctgataaagataattacatcctagtgtctaaaggcaatgatgtgcttgattaagcctatgcatgttgtttggtccttgtatatttatattttcttcaaatttaaatggatactaagtcctctcaacattgtctatagattgctggaaactgtgactttaagcaaaatgacgtgtaacagaataccttttaccatgagctgattgatacaaacaagagttaagttcctgcagcacatttctggtcataaaagcatcactgatcttctaaataaagacccaaaacacttctaaaattaaacatgaaaacacatgtgaaccatacatacattttaaaaagattaataaagggctaggcacggtggctcatgcctgtaatcccagcactttgggaggccacggtgggcagatcacctgaggtcaggaatttgagaccagactgatcaatgtggtgaaacactgtctgtactaaaagtacagaaattaactggtgtggtagcagacgcctgtaatcccaggtactcgggaggctgaggcaggagaatcgcttgaacccaggaggtggaggttgtagttagccaagatcacagcactgcactctagtctgggtgacagagtgagactccatctcaataaaaaataaataaataaataaataaataaataaataaagattaataaaaacatgcaagataatttagccagtttttgattaatcagtgatggtggtggtaggcatggtgcgttacatcaaaaaataattttttatttttgcaaagcaaaaactgtcaggagcacctccccccatcacacagttcaaaaacaatgactagcatggcaggctcactgggcaccttcataccgcattgtttattgttgtgcacttttatgattagcatctactttatcagtttttatttggcagtcgtgagtattcattctttcattttgcaacctgcttattccagttcaggctttcgagtgggtggagcctgtcgtagcatctcagggcacaaggcagggaccactctggtcaggatgtgctgacacacacactcactcatgctgagacgacgtagacatgccatttccccaaacacgcacatctttgggatgtgggaggaaaccggagtacccggagaaaacctacgcagacatggggagaagatgccaactccacatagtggacccagttgggaatcagatttttttcttatcaacattgtaacataatattattcgaagacctgctgtactctgaactgttcattcttctaagggtcttaaaaacttgaggacattgaaatgctatggctcaccctcctattttctttcttaggtatgtttttactgagtcctctgaaccttctttgaactccaactgggaggaaataacagctaatggggggttgttcctatttttgttggcagggtgagggaggtggtgactgaggtcaaactatgtggaaggatattttatttactaaaacaaaagaggcaataattttttactgcaacgttagggatttatgctagataaaaggaagttcccacaatcctgggggaagggtgttaagccaaggcaaagatttcacagctgttgggaaattgctttctgaaaatactaaaggatacagtgccagagtcactggccatctgctaataatttatgttcctcatccccagcaaagataaagaacctgtaaagaaccacccatctagggatacatttccagccccccttttatcaaagcggtgacatgtgaccgaattctgcccagtgacatgtgggaagaagtggctctttcaggactgttcccccaaaactgtctttgggatgctccaaacttctttattcccccaatcctctgatgaacatgcacctgacattggatgctacatgttaaaaacggagttgtcatcttctacctgggtcgctgaatgactgtgtggatcaggaagctccccactcttccctgccatgactgaactagccactgtcatctggagggtgtctgtaatagcatctagcattgcctaacatcatactaatggaacactacatattttcatctgaagtgatatcagtggaatttccactgaaagcaaaggtttagattttggagcaataatgcttaatatttgtcagtaggagcttattaaatataaataccagtcccagtgcttagaactttttatgtgctgtctcctttcattttccttccaactctccagtttgtatcagtcggggaacaccaagttgtgctgtggtgacaaatagctctgaaatctcagtgatataacacaacaaaggtttatttcttgctgatgaagattcactgaggttctgggacactctacagagaagctcttctgcatgtattggctcatcattcccagtggttttactcttaggaacccaccatgtcaataagtagttccacatggtcccaggggaagtccacctggatgtctcacagtggtagtcaagtgctttgacaaggaagtgacacaccctactatcaccaaatcccattggccagaaccagtcacatggcctccttttccctcctgtatccctactatgtgctcaggaaaaaaataaaccagatagtgaagcaggaaggactatatggaaggatattttatttattaaacaaacgaggcaatcattttttactgcaatgtcatacaaatgagaaggctgggattcagagagcttcagtcactaggacaaggttacccagttaggaaagcacaggttttgtgatgaagggtgtcacccaacagtgcttatttcattgaagagccatttctaaaattacttttctgtgttacaacaaaaaataaggtaataagttagtcctcaagcatcttgcagttcagagctggaaacagacaagtaaaacgaccagttacctgcattctaactactactagacatcagatagcactttacatatcattacctcatatcttacgtagtgataagggaatgtgagaaaacttttgcaagtcatcacaaaacacttttttcaggggcataagaatcttggcctaaaatggatcatcatgtaacaggctgagaacagggtagtgggaagttagcgaagcaatgtccccgggacacagcagtgggtgaaagtgtgttgtgattcatgaccttatggatggacggtgttctcatccatctgtccttggctgggtagctgatggaacagtgatctgcttctctgggtatttgggagaaataaataaaaatccatggtaaaatgaagctgtgttctgcattttactcagcacaagcattctgtcctaaactccaaacattgtgcccaatggggatgtcggctatgggtattggtgtgtgtgcgtgtgtgtgtgtgtgagcatgggagaaacagagggacataggaagagacaaaaatatagagaaggagagagaaccccagagagagagaaacagagagtgaagaagaaacagaatattttccatttatttcaagtcagttatcccaagttttagtgggatcaaagtaaaatagataaaaatgtatttattaaatataatatagatttttttaagtatatttcctggttgctaaaaaataatctttgctcgaggcataagaatgatacaatggactttggggacttgggggaaagggtgggagtggggtgagggtaaaagactgcaaattgggtacagtgtacaaattacggctctggtgatgggtgtaccaaactgtcggaaatcaccactaaagcacttatttatgtaaccaaacaccacctgttttcccaaaacctatgaaaatataaaaataacaaataatttttgaaaatatttgctcaaaaatgaggctactgaaatgatgttatgttttcttctattttggttctacctagagaaattttaatgttttatgccaagctgttcatgcttagttctgtttttgttttgttttcttttttgttattgttgtttttgtttttgagaaaaggtcttattctgttacccaggctggagtgtagtggttcagttatcgctctctgtaggcttgatctactgggctcaagcagtcctcccacctcggtctcttgagtagctgggactatatgcatgcaccaccacacctggtgatatggtttggctttgtgtctccacccaaatctcatcttgaattgtagttcccataatccccatgtgtcatgggagggacctggtggaaggtaattgaatcatgggaatggttacttccatgctgttcttgggatagggagcgagttctcacaaaacctaatggttttgtaacgggcttttcctcctttgctctgcacttttccttgctgctgccatgtgaagaaaagcctgtttgcttccccttccgccacgattagaagtgttctgaggcttcccaagccatgctgaactgtgagtcagttatacctctttcctttataaacactaagtctcaggtatatctttagtagcagcgtgggaacagactaatacacttggctaatttttcaatttttttgtagagacacggtctcactatgttgcccagggtggtctcaaactcctggtctcaagctgtcctcccatatcagcctcctaaagtgctaggattataggtgtgagccactgccgccagccttcagtcctttttaaagtggtatacatattctatgtataggttcatggacctgttcatcttttttttgttgttttttcttttttcttttctgagacagagtcttgctctgtcgcccaggctggagtgcagcggtgtgatctcagatcactgcaacttctgcctcccgggttcaagtgattcttctgcctcagcctcccaggtagctgggattacaggtgcccaccaccgcacctagctaacttttgtgtttttagaagagacagggtttcaccatgtcagccaggctggtctcgaactcctgacctcataatctgccctcctcagcctcccaaagtgctgggattacaggcatgagccaccatgcccggccaggcctgttcatcttttaagggtttatgttgtttgactttttccatcacaaatttttattcacctcagtttgctgataactatttccaggtaagctggagtcataacacacatttgccaattatctggagaggagcactacttcctaattatgtggtcattgaagagctagttgatcattaagctacactgatatgcaaagccacaataataaacagcaggcaagattaaaaactccgtaagacataatcccttatggtcctcttcataaacatacaaataatgaaaaaataaatacacgtttgctcaattctgcaaaaccagaaatgtcacagggggggatgcataatagtgattgtattgagggaccaaccttggttgattcttttgtggggtatacacagtaaactcagacataaacctgcaaggtaggcatcattattctccttacctttctagagatgagaccagctgaggctcagagaagtaagttccctggccccacaaagctaatgaagccctggagtttagattcagacacagattctgttatccccaaagactaagaccctcaaaacatgtcaagtgttaaccgatgcctaaatggaactcaatttttccagaaagaccctgcatatctcatttgggcttgcttttttttttttttttgccctttttttcccccaaaatcataattgcaaaggcaagcttctgaagcattgatcaagaatatattttgctttggatgaagaatgtgaaaaatgtgattttagaagaatgctgtaaatatttctcccacttcattttcttttcccttctcctttttccatgctgtgccttttgagttatccccatatactctaagtgccaggtaggtccacgtgggacaaccagagtctaatgagttcctgcgccacgcccacccctaatgaagcatcttcaagtaggatttctaaagacccagggaagctttccctttggtgatttgcaaagtctggccactttagaatttatctcctgcacagggttctgtgtctttgctttttcgatgatccctgtgaagcatgaacccagcacccttgccttcctctttgttggagatggtggttatttgtttgagtcttttagggtgctttattttgttggtttcactgttggcagctggtacaggcttccttcccccagctgtgttggctgttgttttgggaaacaagccttgctcttttccatgcagacctctaccctgggctctgatggtctagctgaggtgaagcaaaccgtaggtgagtgccaacaggggatggccccttcctgggcagaaggcggatatcgatctcatgtcagtcatgttgcctgtctatgaaaatactacatgagcttctcagaaacaggtgatctattgatccccaagctgctaagggggcctccctcatgggttctgcttagctccttaatgagggactcacagctgtgtttatggaggtcacctggaactagaggcaggttttactgggaactctcaaactttgtgaaaattggatgtgtgtcccagattcttagctttggtgttatatccctcaaaggatgccactgagattacatgtccaacacaatcagaggcatttcaacatgtcaaggttttcttttgccctaggcattcatataaaccaatcgttatgaaaccggggcatttttgcttcccaaaggatattgataatctttggttgttgcagttgaagggatgctaccagcatctagtgggaaaagccaggggtgctgtactgctgcacatctaacaaggcaaagaccagctccccacccaacaaagaattattgggttcaaaatggcaatagcattgaggctgagaaagctgatttaagtcatattaaaatggaccccttgtaaatataaaacacaattttgtgatagtaaaaatttccaaagaatttttatcactttcctattgaagtgaattaactcttaatagctcattgaatttatgattagctattatttctcagtaatcatcgcataaacttgaaaattctgatgagaaaaataatgtacaacttattttccaacatgataaaatatttatgaacactaaatttaacaattaatgatgctgacataatgttgcattttggagaaatataattaagcagttattaattttgtctttgttccttgaaatgttagcgccaatttttttttttttcaatttttagatgcccttggacctcaaaggccctgacactgcatgtggagtcaggtgcataaaacatccttgaatctattaattctgggcctcctcaatgaaaggttaaattcatttaaaatacttaaatgatgacatcgtagatccaagaggtcaaataaaataaggatttagtctttttttctctcctttctttttccctccaccatttctctcttctcacttcttcatttctcatcttcttcctctcctgaccgctccttcctccctttctcttctttcctcccctttctttccttcctctttcccttccctcccctttcctagcttcccctcccctcctcacccctttttgaaatgttggagttcatttcaacagaaacaactgagctacagttccagctggttttctaagctacagttcaattattactattatttgcaatttttctcccctcccctcccctcctcttttctcctttccttgaatctattaattctggacctccctcttcctcactcttctctcctctcctctcttgtctcttgctcgatgtctctctctctctcacccttctctttggtgttcactccattctcaggtaaattctccccacaaggaagaggatggatagtatcagagccagcattctccactcagaaagccagctggaagatagagatctcatttcttggttgcttcagcaaaaggcccaggagtagttctaatgggtcctagcataaataaatcactgtggtccggggcacatggcactcattggccagcttggaacacatgtgcaacttcaggaccaggaactacctttccctgagacacttggtctgacagtgggaaatgggtgggttgcgtgcagagcaatgggcctgctgatgccaaacaagaggaatgataccagccaatcaacaaatgtctgctccttaaacaactgcaatgttaagttttgggggagcatctcacactagccctgtggatgaacagtgcttagtcaatggaggaaataactagaactttattagcttccattttacattttattcctttcttccaagtaattgggattggggagagcatcttgttacctgtcgcctttttaactggattctatccattctctgtaactcttagttctttgctctctggctggttttgtcaaggtaactaggtattttaaatcacagtgcaatttcttgtggctcagaaaactgaactgaagtagtaacttttaataggtcaattacattatttttcagcagcctgctgcagcctaatgaaactgcagtttaattaggttggtgtgacgccaaaataaatgtttcattcccagcttgttttatttactcattgaaaagtaggggaatctacaaataataggattggaaaatgttaaaggctaatcagtttggctgcacttgtttgtaaagaaagacgattgtatcttcatcactccagtttggtagttgagaaagctgaaaaacaaataaacaataacaacgacaacaacatttaaaaaaaaaaaagaaactcaaaattgtaggattccttagtagaaggttcttttaacaataataaagtcaactgcaaatactgaaagaccattcagaaagaaacgtaaccaagtcagagtctcctaatgtattctgtgttcctattgtgtggtaagcattgtccctgctgtaattacatctattttctcagtaaaacaaagggaagtcttgtagatgaagttttagggcccatcaaaggtagtactctgagtgtgatcaaaccacactttcactatttggagctcagtgagttaggaactagaagagcagagaacagcagaaaagttgtgttttattttcattattattattattattattattattattattattattattattgagacatggtcttgctctttcacccaggctagagtgcagtggcatgatcttagcacactccaacctctgcctcctgggttccagcaattctcttgccttagcctcccaagttgctgggattactgcccttccccaccacacccagctaattttttgtaatattagcagagatagggttttgccatgttgaccaggctggtctcaaactcctcacctcaaatgatccacctgccttggcctcccaaagtgctgggattacaggcatgagccaccatgcccggcctgtgttttcttttaaaatacagcacccctgaatgacctctagctactcccagtccttccaccctcagctggaagatgtgaattgccacccaccaaggcaggaccagcctggcaccgatcactgaaggattgtgattaagtcagatggttttgccagcagcctccagccgatgtctcatgctgagctattgtttcaacaaaaaatgagatgtctggtcatgttctctcttcctggggcagagattggggacctgcgttgaaaaccagtgacaacttccctttgccttactgaagataaaggggaatcaggcaaaaggatgctcaaccaaagctgcaggcaagcggattcccaggcagaacctggtcaaggctttgtaggcatcacttcttctctgagacacagagagcttggcatctctgtgcactttcataatacacaatggttagcattttaatctctggcagcctcatgcaaagaaaaaaattattccaaggcagtgccaggaatcctaatgtcctccatggtatttttccaaaacaattccttaatagataactatcatctttcctatcttacagaagaggaaacctttatcgtcatgtaggtgtgaaacaagaggtacatttgcagggctgccatgaagcattgtcattacacacatttatggtgtgaggaagtgctgttatagtctccaaaactttgaaatcatctcttcttgacttttacttcgactcttttttcaattttaattctaaggttgacttgtattctcggtcccctttgaatagaaccttagatcccccatgtcacattcaaaagacatgtttcaagtgccgtttttcatcttgacatgttttgcaaggtccttgcctctgtgactttgagatctgtttaattcactgcggtgggctgggtaggactcttccagtcttgtgatagtgctgtgttgctggttagatcaatgacatagactctttctgtttaagaataatgcagtaagcaatggtgaatgcttggaatgataactgtaatcatgcacctgttcactgcagttcaaagggggcaaaaacaggtgtacctttgctggtcatcacagcaaaactaatttagtttttttcttctttctttctctcctctttgacaatttgtgtaggggtctgtgcattaaaatggataattttaaggaaattctgtaaaataggtatgcatgagtattgtagaagtatcatgtagtagagatcatacgcaattatttctgtattaattaaagtgtgtccagatacctttaaacaacagttttaaacgttcaaaacagtggaatacatgttgcccaataagtgaaataatatatactgcaatgtatagaacaggtactagctgtatttaatagtgaagttatgcttaatttgaaatgcttcacatttgtttataaatccatcatcagaagcaatgtttgttatgatcaattcagacgtttggaatcaggaggtccagaaggcagccgtaggcagttgtttgtgcattcagactacagagtatcaagaaaatcccaatttgctcagataggtaggtgtgaaaaccaacaatttctttgaaccactcgtcttacaacctcagtgtattctatattgtgcatagatgacagaagaaacattcattcctaagatacctacaaaatgagcaaaaccagcagcataaatggacccagtagtaatctatctccagtgcgtcttaattttgtgcatcatccatttgtgactttcttttgttctttctgttaatcagagatcttttcagtggcaggtgacatatgcccaacttgaatggccttaaggaaaaaaacagtattgtctcatgtgattgaaacatctatgtatatatagctggtttggggcaaagctgaatcaagatgatcagatgatgttgccaggaatacttcttcccacattacacactcttctgtatgccatgtattttcaggctgttcccttaaagtggcaagatggcttccagcagggatacgcttacatcatcccagctcaggagcctgacggcaaagagaaccttctcttcagtggttcaggataagtcccggccagatctcagttgcttacccatcctaagaagcagggttttgttttaactgcactatcaccacgtaattataggagaaagggaaaaggtttcttcaatgagtctttaaaatatttaacattaaaaaattgacactaaaaattgtatattatgtaaaacaggatgttttgaaatatatatatattgtggaatgcttaaattgggtttaaatgagttaaattaatacatgcattacttcccctgtttattgtgtgtgtgtgtgtgtgttgagaacacttaaaatctattcctttagcaatttcctagtatacagtacctaattattaactgtagtcaccatgatgtacaacaggtctgttggatttattcctcttatctaactgaattttttttatccattgactaatgtctccccagctcccctctctccgcactggtaaccaccattctgttctctgcatttatgggttcacttctttaagattccacatacaaatgagataatacagtatttttctgagtttggcctttttttttgagacaaagtctcactctgtcacccaggctatagtgccgtggtgccatcctagctcacagcaaacttcgcctcccaggatcaagcaattctcctgcctcagcctcctgagtagctgggattacaggtgcacaccaccatgcctggctaatttttgtatttttagcagagacagggtttcaccttgttggccagggtggtcttgaactcctgacctaaagtgatccacctgcctcggcctctgaaattgctgggattacagacatgagccaccacgctcagctgtgtgcttggcttcctttaaggcatcttaatgctagaagaagctagaccatgacagacaagtaaaaaagaatgaaaatctactagggtagaggtttttagtgtaaaaaacagagagatgatttttcaaagaaagaactctcctcaaccctctttttacatacaaacttgtagaaaaattaaaacacacagtgaaaacccatataacttttgtgtagtttcaccaatgattaacattttgtgacatttactttctctttctaccctccgtcttcccatatatattggacaatttgaaaattacaggcaccatgaacaactcatgcctaaaggcttcaacatgcttctcttaaaaacaaggcggtttttgcctggcacagtggctcacgcctgtaatcccagcactttgggaggccgaggagaatggatcacctgaggtcaggagtttgagaccagcctggccaacatggtgaaaccgctgtctctactaaaaatacaaaaattagctgggcgtggtggcacacacctgtaatcccagctactcgggaggctgaggcaggagaattgcttgaacctgggaggcagaggttgcagtgagctgagattgtgccactgtactccagcctgggcacagagcaagactgtgtctcgggaaaaaaaaaaagaaaggcagttttgctatacagccacaaaacaattcttatttttttaatgtagatactaactggaacatgcatcgcacttagttgtccttatttctttcacagcttttgatctagaagagtactctcggctgggtgcgatggctcacgcctgtaatcccagcaatttgggaggccaaggcaggtggatcgtctgaggtcaggagttcgggaccagcctggccaacatgacaaaacctcgcatacaccaaacatacaaaaattagccaggtgtggtggtgcacacccgtaactcagctactctggaggctgaggctggagaatcgcttgaatctaggaggtggaggttgcagtgagccgagatcatgccactgcactccagtctgggcaacagagtgagactaagtctgaaaaacaaaaaatgagaaatgcaccttcctccctgcattttttggtcttctatgatgttgatttacaaagttagtcttggaccattttcttgtagaacatctgaaaatcaggacttacttgattatttccctgtcattcagttcaacttcagcactttgtggagagtgctccccaggccatgctgtctcactgcctccttagctggaggtccttgatgtcactttctcccatgatgtgtggcagtaaagttggtcactgggtaactgacaaatttccccaggatacactagtcttgtacttaggaaataacctatgcatctgtactttgatactacctaactatccttttttccatcatcccttcatcattgaggaaccttttcagaatgggttattacactgatagtagtgacatgatgcttttctaattttatcattccatctatattacaaaaaaacccctaaatattggctgtacccactttagtagaaccatggcacccagctagaataccactgccagaaaagaaactatttttaaactatttggcaaaaataacagaactctaaccagccaatgggttctccttgcctgctgcctagacaaagctgttttatcaagacagggaaattgcaatagaaaatatgtgtaattcacccagagccagctgtatgggagaccagcgtgttgttattactcaaattagtctccctgaaaacccaggaactggggtttttcaggattatttggtgggtagggggtcagaaagtggaagtgctgactggtcaggttggagatgagtcacttcctcggtggggtccacagaccagatgagccagttgatccatatgggtgatgcccactgatccatcaagtgcagagtctgcaaaatatctcgaccactggtcttatattttacaatagtggtgttatcccaggagcaatctggggaggttcaaaatcttgcagctcctagctgcaggactcctaaatcataatttctaatcttgtggctcatttgttagtcctgcaaaggcagtctagttcccaggcataaagggggattgtttggggaaagggctgttctcatctttgtttcaaaattaaactataaactaggttatttccaaagttagttcagcctatgcccataaatgaacaaggacagcttggaggtaagaagcaagatggagccagttaggtcatacctctctttcactgtttcgatttcctcagctataatttttacacaggcagtttcaactccacctgtagctacatcatgagcttgaagaaaagaatcaataatgaccacaatttccagtcactcctcttctgatagaaaggccaagaagtagctcttagtcttggttggggatctcttggccaaaaagaaaaaggaaagagaaaagataactgaaacagtgacaactgagagaagaatgatagcgttttgtaagcatcaccattttttcagcgttaaatactcagaatggagtatggggaacttctaagttcacatggcatattcaaattctccttgtttagaatttcaagagctattacttttctttgattcagttcgattatctttcatgatcctcagaaattgtacttttctccccatttcagactaagaaagtccttagccaaatggcctcaaccatcggatttgcctgtaggtgtcattcatttttgttgtttcttcccacctccctggggtttttcagtagtgcttcctttcaatcaaaagctaattttttttgtgtgtgtaggtggtatagaattccatgcttttacacagtagcaggcctgtatttgatgtacctggttcagagacaattgtcctttatagctttcgggagtaaattcaatgagagccccctgcgactagtttgtaactcatttagtgagagttctacaggattatttcacaaagcagttctcagcttaagaagctaaattggcttcatggggcctagctggaggcctcttcatccctgcattcagaggatatttacatgcatactacgaatctttctagaaaatgggaggagggttcgtattgacggtcgtacatttcctcaacttagctgtccgtgaagggtgttgggatgggtgtttgataattagggagaatattttgtttcataatacatggacagctctgtcatattggcaagtgcgtttgacatgcaagaattgtacagttataaggagtgacccgtggcaaaagcagaccatgcatttgcacatttaggttagtatagtgggtaagatgagagactttggagtcacactgcgagagtcccagtgctggactacactttgggaaggtacataacctctctgaacttggttttggcacttgcaagatgtggacaagtataattgtgtgctgggcaggatagcttatgtgtattaagtgctgtgattattcttagatttctttgtctaagagttcgcacactgtgtattatacaataaatacattcataattgaaaaacctggccaggcgtggctgctcatgcctgtaatcccagtgctttgggaggccaaggagggtggatcacttgaggccaggagttcaagaccagcctggccaacatgatgaaacaccacctctactaaaaatatatattttttaagtattagccggtgcagtggtgcatgcctgtagtcccagctacttgggaggctgaggcatgagaatcacttgaacttgggaggcggagattgcagtgagctgagattgtactactgcactccagtctgggtgtcgtagtgagactctgtctcacaaaaaaaggaaaatgaaaaacctttgtgttatgcatattatacagagccctttctaaaaagaacagcagggcgacccctgcctgagttcctggtagagctgggagaggagaccatttatgcactgggagtgacccagtcatttttgtcagatgatagaaactgcttttcttcagtatatctctgtcttagtcttagctgttgtgacacggggcaactctagtatcttctgctttttctacagcttaatttctatctaatttgtactattatatttaattggaaaattgcccagaaagcagagtctgcatttgtaaatgaagaaggagaagcattttaaacgcactaacaaacctcactttttaaaacaagattaacgtcttttacatgaaggaacccttttgaaagaatttgggaaaagacatgagaaaacacatttgctttgtgaactggaattttatatttggaactggcttcacagaagacagagatgttaagtaatatttgatgggtgtctactgtgggctgtatgacttcctaagcatcctattatttaatcatatagttgtaaatataaaacttaacagtttcagacttccatgtgtgtgaaattggagatttggagactttagacacacgttccaatgtcagggtaggacgattgagtcagccagaatttcacatgtatctctccaacttcttttctttctgtccctcctttaacgtctctgcaatatttcaatttcagaaaattgaaagaataataactaccagccattgggctttcttttgtgtggtactaggcagtaagttggacattgcatacatattaattctaagcttcctccatgatggatattatctgcagttgtacatttcttctcctttctcttagctatccacaaagggtctttggatgggtgcttcataattagggagaatattttgtttcataatacaggaacaagagtgtcatatgggagggtgcattttacatggcaagaattgtgcagtcctaagaaatgaccagtggtaaaatggagcgtgcatttgtacatttaggttaggatagtgaataaggtgagagactttggagtcagattacaggagtccatatgctggctccaccatgtaatacctttctttgctttgaagagatatacatatggggaagcggaagttctgctactaagtaatggaatttgctatctgtttagttttgaagctcatagtcccctgagaaatgtcgtgtgtgtgtgtgtacccacctgtgtgtagatgtgcacagagagctccccctggtagatgaaatagaggttattctgttgtaggcaaatgttccctggacattaaaatactggattccagttctattcatccaggcaagttgctgattagctgtttttttctcaggggtttcttgagcatgtgattatgcagagagagtggagatcattggctgggcacggtggctcatgcctgtaatcccagcaccttgggaggctgaggcaagcggatcatctgaggtcaggagttcacgactagcccggccaacatggtaaaacctgtctgtactaaaaatacaaaagttagctgggtgtggtggcaggtgcctgtactcccagctacttgggatgctgaggcaggagaatcacttgagcctggaagacagaggttgcagtgggctgagatggcaccattgcgctccagcctgggcaacaggagtgaaactctgtctcataaaataaaataaaaaagagagtggagatcaccctcttccacgtacccatctctctctgccctactggatctcatgtattccctaaaatgtattgctcaatacagggtgtaagtttaccaggtggtgttataatcagttcaggcactaaaagaaagggttaaaatcatgcggaatcacagagaaaaaataatgatctgcctatcctttttcctgagagtttcctgatgccccaagaggaaatattcagtttggtgatcgcctctttttgatgacatttgccagttttccttgtactagagggagaattgagcctcaggctgacaatgggatccatctagaatcgaggattgtggctttgctttggtcctatttgttttcatttgttgcttctcttcatgatagaattcctggttttcaaattatgctggtaatgtgagtgccctgttcatttgtttttcagaatttaatgtatgccaataaaaaggtgaattgtttgaaggaagtaagatttttacttcttattttacagaggcatgccattcagtagcactggaacagagaggaggagaaactggagagcagaaaggcaggtggcattagcatatgtcagattttcaatgaggactacggatatggcaatattgggaaggtgatctctgaatgatggaaatttaggaaagatgtttaaagtgcttgtctctcattgcctagcgatttactggcattgtagactccaccccaatgcttttgttcaatttggcgtttaggattagtcatgcacgtggaagattccagcctccctccgcccagtgttacagcttggactgaatatttattaactacccagggaacatcacactgtttgaggacacttgagttcatctatatccacaaaatgtgtcctcatcatgttgaagtggaacagcaattcataagaaatgacaggagcttagcaagaatatataggggaaaatcctttgtctagtaagagtgtgaagtgcccaggaaggtgcttccagcaaataatgctgaatgttggtgactgctaaatgaagaaggaaacacgaagttcagatttaacagaaccatctagacagccatacttcccatgaccctgggaggccgacaagatcccatatttaacctatccttaccaatgttatgagaaaaacaagaatgcatgtgcgattataaatggtggctgactttcaattttaggttgagatacaaaagcaggtggtgggggggtctgtggcaaactcggcaataaatgccccaggtgaagaggctgcccagctctcacagattgttgacatgtaggaatcagtgcctctgattttccaggaaaagtcaagaatctaggtttttaatgtaaaagctcctgtttttcaattatgggcaactagtttattatttaaactacttgggctaggaccctaaataagtatgttcaggttgtggattgtacaactcaagggacccagcacgctcatctttgtacttttttttttgagatgtttttattgaggttcacttactatatggtatgcgtatgccacaaaattcacctatttaaagtgtacacttcagtgttttttgttggtttgtttttgagacggagtctcattccgtcgcccaggctggagtgcagtggcgtgatctcagctaactgtaacctccgcctcccgggttcaagcgattctcctggctcagcgtctggagtagctgggactacaggtgcgtgccaccacaccgggctaatttttgtgtttatagcagagacaaggtttcaccgtgttggccaggctggtcttggtcttctgagctcgttatccacccgcctctgcctcccaaagtgctgggattacaggcatgagccaccgcacctggccttccgtggtttttaatgtattcacagagctgggcaatcatcaacacaccatcagcgcattctaaatttagcatatttttattgctccagaaagacacgttgtccccattagtactcacaccctgtacacccttaccccaccctgtagccctacacagccagcattctgctctatctctataggtttacctattctgggtatgtcatgtaaattgaatcatgtaatatgtggcctttcatgtctggcttctttactaagcataatgttttcaagggccatcaatgttgtaccatgtgtcaatttaattcacgttttgtagccaaataatattacgttatataaatatacgacgttgtgtttgtccattcattggttgtcaaacatttggattgtttccacttttcagctattagaaacaatgcttctatgaacattgatgtacaagtttttctgtgtacttacgtttttatttctcttggatatatacctacaagtggaatttctgggtcatatggactctatttttaacattttgaggaacttccaaaccgttttccaacgtgggtaccccattttacattcccaccagcaatgtctctggcttcccttttgtccacatcgtcacgaatacttgttattatttctctttgacaatagccattttgataggtatgaagtacagctcatcatggatttgacttgcatttccctaatgattactggcattaagcatctttttaatgtgcttgttgggcatttgttgtatcttctttggacaaaccctattaaaaaaatacttcgccaacttttaaaatagggctatttgtctttttattaagttttattgttggaaacttttttattaagttttatataagggttttaatggaactttttatttttaagttgtatgtaagggttctatattctgaataaaaattttcaaatcacatgtgatttgaaaatattctgtttcattctgtggatttcctttttacttcttatatgggattgtcagcagcacaattaaaaaatggatacagtccaatttattttttattgcttattcttttggtgtcattttttagaatctgtttttcaccccaaggtcacagagatttactcctgtttcttttttctgggagttgtatagtattagctctaacatttaggcctatgattcattttgagttaaattttgcatgtggtgagataaggatttgcatttgtatctttgcatatggatatccagttaccccagcaccattcattgaaaatcctattttctcactgaattgactaggtacttcttactgactttgaccctagggtgcgtcactgcagttgtttaattgtagaatgtaaatatatgaaggtatattaattctcctactagggaaaaattaactgcaaaaggaggggtcccactcctgtgttcctggcatttttagtttctgcatcagcctcaactctaggataagagatgggtaattcttaatgagaacagaacttcagaataaaagtctcagctggaaaataacttgattttcagtaggcttgttcatatgttgtatatatgtgacttagataatcattataaatacagttgattctaccaagtcttttgaactgtaagtcttagctgggctctgagcaaagcccttcttccttcttggatatacatgcatgcacagccacacacaatacacaaatgtaccctggtggataaggcatttacaattgagaacagctgatagttctatatagtgctatatcgagatagagaaatagctaaagatgtaaatatacacacccttgatacattcatacacacacacagcattaagttaggcagcccctggtttctgccactagcacagctttctgaatgaatgagctctcgagaggggaacttactggaaagctttcttatcaacttggtaaaggtttgattttcttgccccctacagtggctgtttgtcaccctgactgcagctagaattgctgtgttctgttctttttctggagaaattacaaaaggagttgacatctactgtataaaatgaaacctagcaaattttataaattactaaggacgattctctaatcttcatatctcatctccagcatccaaggaggtggagaagtagttgggtgcgtattcacctagactttgttttgcagtaatgtgtgccagttttataccctaaagccatctgagtccccttttcctttccctgtctccattatccatctggataagccagatcttcaatatcctagcctcctttaaaaccagggacccaaccaggcgcggtggctcacaccagtaatcccagcactttgggaggccgaggtgggcggatcacaaggtcaggagtttgagaccaccctgaccaacatggtgaaaccctgtctctactaaaaatataaaaaattagccaggcgtggttgcaggcgcctgtagtcccagctattcgggaggctgaggcaggagaatggcgtgaacccgggaggtggaagattgcagtgagctgagatagcaccattgcactccagcttgggttgagagcaagactccatctcaaaaaacaaaacaaaaccaaaaaacagggacccaattctggctgctgaaacatcagaaagaagtccacaggaaaggtagccaggattttcttccagtttaaaaggagcaagccacataagcagccacctttttctgcactgacagttacctgtgccttgcctttgggtgtggtgttgatccttggagctgccatggccatcttggcaccatgaagtgagtatcctcagaacaaacatttgttgggctaaagagggtgaaacagaaaagtagaaggaactttggtccttaataacaccgggagttgctcagaaagtccagggctgccttttattctggaattcttatttaagacaaaatgatatctttatggttatagtcactttggtcaggtttggttttctggtacttgtggcagaaggcatccttatagatgcacctatacatataccaatgtatccacatccgtgtcttcacacacacatctgtttcctatatgcagaacatgcattcataaatatgtagggttttttaaatgtgatcagacactatatagtttctaacttgcctttttttcattccactatataattaagacatcctttcttgtcaggatctaaaattattatttactcttttaaaagactgcatgttattttatattatgtatggacctgatttatttaatactctcctattagtagatgtttaggtagatgtgaattgattggccagtacaaagtaaaagtgtaaccagtgttataaaactaatgttcttgttatctcccagtaatcctattaatcagtctgtagaaaataaagaggacgtcagaccgatatatacaaagatgattattccaatattaagcataatggagaaacatgagaaacactttaaaagttcaatataaaaggacttgtagtttatgatctatacatatgataaacagtattatgtgaccattcaaaatggcttttaagaatacgtagtggctggctgggcgtggtggctcacgtctgtaatctcagcactttgggtggctgaggcaggcagatcacgaggttgggagttcgagaccagccggaccaatatggtgaaaccctgtctctactaaaaatacaaaaattagctgggcatggtggcatgcacctgtagtcccagctactcgggaggctgaggcaggagaatcacttgaatccaggagatggaagttacagtgagctgagattgcgccactgcactccagcctgtgtaacagagcaagactccatgttaaaaacaaaacaaaacaaaacaaactcctctgtttcccatcccagtgtcagcacgtaaggtgacaactgacaagatctgtctcataatgtgaataatggttttctctgggaggtgagaagatgaatgcttttagattaaaataaataccagtcagtatgttccaaatcacctgatacggtcatttggcgttatccatgtacttgtacaaatttttctcttctaacccacatgtttctactgttctcatccaaagacgtgttgcaaatcattatccagaacatgggtattgataactgcaatgttcttggggctttgcataacttccaataaagcaaaaccacatctctgaatccattttaaatttgcagtcagccaggggtcctctaatggttgtgcgttttggggaaattgtgacctgggtctagtaatgagtctcttccttgggagttaaagtactctgggaacatacaccatctatctcagaatactttgctgaaataagaataacaaggacgcttcaaaaaaatactaagcgacacacctaaagggcttaaacactaataagtgagagaatctagtggctaggaacttcagttctcaagccagtaacaaaactcctaccatttcttacttgcaaaaacttgattttcccccgtgtaaatcaggctaatctttttattcctttactagtgacactaatactattcagcagccatatggcagagtgcttcagaactgctgctgtggagccgaacttctccactactctgtttcccatcccagtgctcaccacctagttaagccatcttgagcaggtgcgtgtaacttaatgcaaccttcagttctgtatttctgaaaggcaattaatgagagcacttagcttagagagctgtgagcattacatgagctaacacttgttaggcaactagaacagcaccctgcacatagtaaatattctgtcagtggtacaaagtgttaacccacaatcaacaaagcattgaacgcagtccataactcacagtaaggtatgcaacatgttgtcctattgccatcttcttcccaaagcccagataactgcaaagggcatctgggtggcactgctgggactggaacatgtagaggaagagggttagggaagcattcatgggtttttcaagctcatttttctcacttcccttaccagacccatcacccaatttagtaggacacagaatcagattattattactttttgtcttctcaaagacacatttttccttgaaattaatggtggtgctgatgaacacgaaatccaccagacagaatctcggggcttttgttctcagtcctcccctacctggttctctctcctcccccatttccctcctgcccagcattgagctccagctgagctactgtcaggaggctgctctgctaagcagtctgtcacatgttccgttacaatcatgttttattatagctttcaaaagatgacctctcattctgcacactcgtgttcatagaggacttctggcattctgaaaagaaccagatagcagagtctccaaaccctttatttgcttcagctgataactgctctggccagagacgaacgctgtggtgattataagatgtaatttactacaaaagaccgttaatattacttacaaacctgccatcatttctggggaaatcagaactgaaacagtggacgggacacatctgaatccacctaaatatcttggcctgatagaattacaagtttatagatttaccatttaggaaacagccccgttatgaaacatttgtcctcacagacagacagtataagtaacaagcaagattatatccttttatgtggatcaaggacatagtcaatgtaagaaaaaaaagatagaaaaaaaatccctttagaggaacgtaaatgctgcccttgtgaattataactggggaattagatctatgaaaaagcctctaatatgactaaacaaagtccctcaggtgatactctgagtcagaaaagtgtgagaaaatatagcctcttaaatgtgattatagtcagagctgcagttactccctgagaaaggacatagaaggtagaggaatgaaagaaaaaaacagtgtttgaaaactttttgtgtcagaccagaaattatagagtagcaacagcttagggatttaagtaacccctttagcctagttgtaaagcctttgggctttaaactgaagaacagaaaggaattagatatccaacttagtacttgtttttttaagatcatgaaatggaagagtcttttttgctgaatgacgaattgaaccagcatataattccaactagggctataattagaaagatacggctctagtatttaagcttcttacactctcccctctctcatgaactttcattagagtttcttgtctacttggttatatttaatggagatgaaggtgagagttacggtgcttttgttggtattgtggccagactccgggagagtcctaaaatcggtgtttgtcatttacctctcctctttgagaaattttaagggaactctacatacaagaagctataccagcgtaaggatcctggaccattctactcatagttttgcaagcaccctatgcttggagttagctctggttaaaggctgtaaaaggaccactgttcctccatcctatccccagtccaatccttgggactagctcgctcaggaactctcagaggtacatattaaaaagaacgtataagaggtcagatctgtaggagaggcttcatcttaagtcattctcccgggtatatttgttgaggtcaagagcaaggaaggagaaaagatatagctgagtttaaccaaagcaaacaggaccttgctcagccaactagtgctgcccgcatggaattgaagatgttaaagagaggggttagagcttgaagaggatgttaaagagaggggttagagtcacagtttgtgcattttaaaggacagtgaccttgactagtggtaatggggtcaaatcattaattcagaccattcagataaacaactcttctctcttgtcaggtaggacaggggatggaggaatgaagtacctagaagcagcttggtaggagaacaaaggcgtcctatttctctcctttccctccattattcatttattccctaagttgtttattggccatttgtctgtcttctttggagaaatgtttgttcaaatcctttgcccattttttaatttgtagtttgttgttgctgctgttgaattttaggagttctttatacattctcggtattcattcctgataagatagatgattggcaaatattctctcccattcagtgggttgccttttcactcttttaatagtgtctttgatttgctaaagtttttaattctgaaaaagtccgacgtattctttttcctttttgttgcctgtactttttgtcctgagctgtttataaggaaaacagcaaaccgtttgtctgagtataggatggtctctctagagcaagaagggaaggcaggtgaatctcatgactccagctggaaggagagaggatcagtctgtgctgaatccccaacagctgacctccaagaggtcttgatgttcttacagaaaggccacctgcaggacagggttgtgtgtgctgctgggaggccaggcggggactcctgggaaagccttctcctggctccagttccatttggctcatctccaaggtggccaggtactcactgatgcatggacagctcatatgttcatctgtgaactatgtccaggctcaagatgagctggaagtgcaattttttttccacttgctgctttatcccttctgtgcattcctcttgctatcatttagcacctggaaaaatgtagaattcaagatcagaaagacaactggagctcatgccccacacacccccaccatcacatgcaaatgaaattactgaggcctggagtgcttaagactctttcccaaatcctgtcactaataaaacgagagctggagattgggaatcctgacttgagccggtgctgttattaccctttttctaatcatcagtgcacccaaggaaaaagaagtttcccaattttatttatttcagtaagtatttactgtcattgtctactcttcatcctagtagcaaaaaaataaaatttgcaagtggaaactaatcatcaccgttgtggtcttagctgaattgttctttacagatctaaagagagaccacagaaagatctgaatggcagcatgccttaagaacaagattgacccagcttacttgtctcagggccaagtatatggcagaactcagtcatctaaaggagagactgaccccggggaaaggcagcccacattgccagagcttctgattttttcaagagaacctggcagttggagtcttgtatgaaatagcttgatgtatacaactaaaggatttaagggaatctgtttcttaaaatttaatatgaaggccaccatctcctgcacaaaacaaaaatctttttgtgttatcaaaatggactgttgatttaagaaccttgctcttgctttagatcagagccctcaaacacattggaatgattcggagagctttagaaaacatgcatgccttagccccactccacactccatgattctgagcctcttggggtaggctctgggcatcagcacttgagaaagcccccccgggcagccgctatgtgcagctgggggttatgcaccactaggctgactgtagtgtgaacattgaggatcctaccccaatcctcttctttcccatgggtaaggacatctggactgtgattgctggacatcaggatggccttaatattagggttaacatctgaatcattggctgccttttttatttctcgtcctgctgtttgggtactttatagacatagacagttgtccatgtgaccccatttgcctcgagttgcttctgtagagttttgatcccacactttgtgatgtgtctcagctctggggcgagggggctgttcagtgaagttggtttgtggcttcttccctctgatctccttttcttctcccagccttgggggttctgcagctaactgtggtcctttcatgtagctgcctttggtctgctggggactttgaaggtttgcctttgaaacacccagatccctttttggttccttcctctaccccatctgcttctctccactccccttactgttggcagcatcccctcgccttggcagtccagcttttgagagtcactgtgatcaacccagcaattcctactggggaaaaaaaaaagaaaaagtagggagccatgataggtgcaccatgtctatcaaagccatcaaaatggctattttagaaaaaaacctcaataaatattattgttgatcttgttacacatgataacagcattttcttatttttttaatttattttttttaagagatagggccttgctttgttgcccaagcaggacttacagtcttgcatttaagtgatcttcccatctcagcctcctgaatagctgtgcattcttgttatataagaaagtatctgtaatttttagtggcacaattggattataaagtagaggttaaatgataggaactctggagttgcttcaaatactttagaaaataaatgaataggtaaatagcaaggtaaagcaatggtggcaagctcttaattactgttgtatatgggtactgagtatataaaacccattatataacatgttctacttttgtgcatattgaaactttttattaagcatatacacatgcacacacacgtataattgtcagccctataacattctacaattcaataggaatatatgattccaagattctataattctttctttcttaccaattaattggtgcttgagattgatgtaactgaatgaatagatgacttcataaaaagtaaatgagcttgggcctggtggcacacgcctgtaatctcaacagttttggaaccttaggcaggcaggttacttgagcccagaatttgagaccagcctgggcgacatggcaaaacctcatctttaccaaaaaaagtaaaataaaattatatataaatataaatgtatttatagtgtgtgcatatatataaaaatatataaacacatgcacaacgtgtgtatttttatatatatacacacacaaattagctgggcacagtggtgcgcacctgtagtctcagctactcgggaagctaaggtgagagtactgcttaagcccaggagctcaaggctacagtgagatgtgatcaaaccactgtactgggtgacagagcaagaccctctctcaaaataaaataataatttataatgaaaccaacacatacaattaaagaaataaaaaataggccaaatagcatctatacttcaccttcccaacatgttagcttttacaggtagctgtctggcatttgtttcattgctgtccatctagtttggagttttgctttattgatttatgatattatcaagcacagactgtgaactggatcttatattgtggcaatattagctttctggctgctttgaatttgcagtcttaacccccaaagagagaaatcagaaatgacagcattttggccaaatacaagcgtccagtgcatttgtcatcggagtgatcggagtgaatctctcatttttacttgtgctgctactttacatgtagtgacttcaagtacagagtgaaaacttaatactcgttcattgttccagaaatatttattgggtactggctccccgccaggctctgggcagggcctagatgctgtgtcagcgaacaggagagattcagtccgtgtgttcgtggaggttgcatttagacgggcatttcattatgaaacaacacacgggaaactatacttgaaatatgcatcctggcaggccacagtggctcactcctgtaatcccagcactctaggagtctgaggcgggtggatcacttgagggcaggagttcgagaccagcctggccaacatggtgaaacctcgtctctactaaaattacagaaattagcggagcatggttgggggtgggggcagtgcctgtagtcccagctacttgggagactgaggcaggaggatcacttgaacccaggaggtggaggttgcaatgagccgagatcacgcccctgcactctagcctgggtgacagagcgagactctgtctcaaaaaagaaaaaaaaagaaatatacatcttataatgctgaatgtatttccagtaacatgcaagtgttgtggggagataggcagagacttggacaggtaatcggaggctaaaataggaatcctgtgaagtactactgcctttgatattttttccaagccaatatattagaaagccacttcttcctggaattcatgtatccagacacatttttatcttgatgaatttggggttgcatgtctcaaaaatgactgtacgtgttttaaaattttatgttctggggtacatgtccaggacgtgcagatttgttacacaggtaaacgtgtgccatagtgatttgctgcacctatcaacccatcacctagttattaagccccatacgcattagctgtttatcctgatgctttccctcctccttcccctctacgaggccccattgtgtgtagttcccctccctgtgtccatgtgttctcattgttcagctcccacctggaagtgagaacatgtggtgtttggttttctgtgttagtttgctaaggataatggcttccagttccatccatgtccctgcaaaaaacatctcattcctttttatggccgtatagcattccatgttgcatatgtaccacgttttctttatctggtctatcattgatgggcattttggttgactccacgtctttgctacagtgaatagtgctgcagtgaacatacgcgtgcatgtatctttataatagaatgatttgtattcctttgggtatatacccagtaataggattgctgggtcaaatggtgtttcttgttctgaatctttgaggaatcaccacactgtctttcacaatggttgaacaaatttacattcccactaacagtgtaaaagcattcctatttctccagagccttgtcagcatctgttgtttcttgactttttaataatcgccaaaaatggctatacattttttaatatacctgaggctgctgccttccaaacctactgactaatagtccctgagagtggaagtcagcactctgcattttagcaagcttcctagagaatttgtgggtgaacagatgagtgttcatctgactactgattggggacaatgacagaaagatatcagaatgtgctttgaaccatcttggaacaattcattgtggttattaggattaaaagggaagagaaatgtcagctctcatattcacatcccttaaaaatcaagcattaggatataataattcatttaatataaatgttataaccatatgaccaatttccagttatcataagcagttaggtctttcagtctctctcctctctctctctctctctcgctctctatctctcttcctctctctcttcctcctctgtctctccttactctttcttcctctctctcccctctcttctctctcctatctatctcctctccctctttcttcctcctctttccctcttcctcctctctctccgtcctgtctccctcctctctctctctcctctctctttctctctcttcttcctcctctatctctcctctctctttctgtcttcttccctctctgtattatgtctgcctatgtgggcatgtgagtgtgcaaataagaaataattattttagaattttgtggtttccccctgctgtatatggttccaaaattcagtgtctacaacatagctcccgaataatgtttcacatcctaatgagcgatcatagaatgggagaacaaacttaacatgacttacatcctcatttagcctttaaaattctctttgtccacaaacctccttgtttctggagttggcaacatactgaaatagaatatatacaaacttggaaacagctatgagcttgacctaaaaccttaactctgaccctttactgggaaggctttggtaggtgatacatcctctgtaatattttatcttctacatcaaaaaagtccttcattgtacagaattttgagagaaattaatgagacaatgtctcatagcacctgaaacaacgggttctcaagaaatactatttcattgattactcctcactttcttaactcttaccagacctattttgagtctgtatccttggtatcatcattttttctcaaattatttctaaggcagcattggtttgtgttataatcattaatagatacctgaattaagtgaaatatttcaaagtaaagccatatagtatcctgtggggaaaagcctatcttttgagccagaaagactggcttaaatcccagtattattgttcacctctttgtgggttttgtttatatgtttatacacattagttttaccatctgcaaaatggggataacagttttcacccttattcgtttcctgttactatttcccaaattgtcacaagcttagtgacttaaaacaacagaaattgcccaggtatggtggctcacatgtgtaattctaatattttggaaggctgaggtgggagaatcgcttgagaccaggagtttgagatgagcttgggcaacatggcaagaccccatctctacaaaaattaactagtcatggcggcacatgcctgtggtctcaggagggtgaggtagaaggatgacttgggtccaggagtttgacgctacagtgagccatgattgtaccactgcattctaacctgtgcatcagagcaagagcttgtctcaaaaacaaacaaaaacagaagttggtcatctcatagttgtagagatcagaagtctgcagtgtgtctcactggactaaaatcatggtgccagcagggctgtttttttcttgagcctgtagaggagatcttttttcttgcccttcccaacttttagaatccactctgctcccttgggtcacagccttttccaagttcaaagccagccatggccaggcaagcctttcttccatcaggtcactctgacctgacccttctgtctccctctcccatatttgaagacccttgtgattacctggagcccatcttgatgatcctgaataatttccctatttaaggtctgctaatcagcaaccttgattcccttttaccatgtcatatgatacattcgcaggctccaggacagacatggacatctttaggggccacaattctgccttccacagccactttatagatggttgttgggattactgggaagatgtagtaaagttcttagcacagtggctgggtatggagtgtagtatgttctgtagatggagaggttgacgtggaaaatgattttcttttttctcttttttatttttattttttgagacagggtctcactctgttgtccaggctggagtgcagtagtgcagtctcagctcactgcaatctcctctgcctcccaggctcaatcctcccacctcagcctcccgagtaactgggacaacaggtgcatgccaccacacttggctaatttttgtattttttgtaacaacggggtttcactacattgcccaggctggtatgatttttctaaaatcaaggcatttccttaatttaaaaaaaaatttgtttatttctttactggattagctgtttgggggaatcctgaagttaaccctatgtaaagattcacccagatggttcagtgtttccttcatagataaccccctttaaaaacactagcaatgggtcaggcatggtgaatcaggcctgtaatgctagcactttgggaggccgaggcaggcaaattacaaggtcaaaaggtcaagaccatcctggccaacatggtgaaaccccatctttagtaaatatatgaaaaatagctgggtgtggtggtgcgcacctgtagtcccagctacttgggaggctgaggcacgagacttgcttgaacccaggaggtggaggttgccgtgagccgagatcacgccattgcactccaggcctggcagtagtgtgaggctctgacacaaaacaaaacaaaacaaaacaaaacaaaacaaaacaaaaacccactaacaatgatgatgtgggggaaaatggccagacagaaataaaataagaacggaggtagatgacattcaaagtgtgtttcatggacctcacgttgattctcaaagcctgaagctcttcggtgtgcattagactaaattatcattctgctgagagtgcatctatgttttcttttccactgtttgtttttaaatgttgtaaaaacaataataaagtatggcattattagtaagcatgaattatggaagaaactcatctggaccagggaaacattgacattcttatttttttagaggaagacagagtatcccactatcacccaggctggagtgcagtggtgcaatcatggctcactgcagcatcaaccttgccggctcaagtgatcctcccacttcagcctccagagtagctggaatcacaggtgcatgccaccacactcagctgatttttttgtactttttgtagagatgaggactccctttgttgctaagactgctctcaaaatcctggtctcacaggatcctcccaccttagcctcccgaaatgctgggattaccggtgtaaactactacaccccacccgatcaacattatcctgattatacattaactcaggtgagcttcatatatgtgaagaaacactgaaagatcagattgcgaagtggtcttgttactcagcagcttccgccaaacaatcactaccatgataacatcaccaacaaaatgtctgtgactttcacatcccctgctttgagaagtagaaataaaaatgttctgggcatacataccacttatgaattgactgccaaactgttcttttaaaagtaggtcatttgatatgcctgttccactgataacatatcttaatatatagtagaccataaaatgtggaagatcataatatacaatctgcattcacttagcagcaactttttccttagctggagcacagatatacttaataccaaattagaagaaagtgtatgttattgtggaaataagattttaccattaaggcctaagaagcaaaagcaggaaaccaacaggaacccataaatggttggagatgacaaagtggactgtaatagtctttgtgtagttatttttttgagggggaggggacgaagtctctctgtcacccaggctggagtataatggtgcaatctaggatcactgcaacctccggctcccaggttcaagcaattctcctgcctcagcctcccaaatagctgagaatacaggcgcacaccaccacgcctggctaatttttgtatttttagtagagacagggttttgccatgttggccaggctgatctcaaactcctgacctcaggtgatccatctgcctcagcctcccaaagtgctgggatgtcaggcgtgagccactgtgcctggccgtcttcatctgcttttacatgatgcttcctgtttccctcggagaggtctccttggatgctctttgcccccgtgtgattctggtactcatacaacttgacatttcttctcatcacatgagactccacagtgagcatggtttttcctatccgtgttccgctgttcaaggaaactgcctgcagatgctcagagctttctttctcctttctttgtgctttatcagagcaaggatgattccggcttaccttgtccgtggcttctggatattttcacccagtagagggcgtgagtggaaactctgaatgcaggagaagccagaactcatcttccccttctctctctgcttcccaaggcaccctgagtcctccctcagggccctcctccaaggccctgtctcccgctgggcagtgtccaccatggcacgtgaccctggtttctggtctctgaagacacctcctcttcccattggttgcaagggttttggtagcttctgcagtcacctcttcctcaattctgttaccgttccttctttggcctctcagatctcccgagtccccttgatgaaaaaattccttttggttgaaaagtcccggaatagttcctgtttcttgcattattctaatatatttacgtctaaaacaaccctcccctcttgcatatggtacatgatgcatctagggattatccctggtaagaatttgctcatcttttattttctgtttgtttaattattttgaaggaattttagactcagggtaagtttagctttatagagagtcctagtatactcttgaccaatattcccctaaatgttaaaattttgcatgatcacaacacatttctcaaaactaagaaaccaactttgggatgatattacaaactaaactgcaggcatacgtttttaataaaaccaacattgccactgcttttaaaagtagtaaataaaaacacatatcatgtatgcatatgtgtgtatgtgcagatctctaattacgtatattgacttatttaagtttcacgtgtacttacagcacaaactacttttacaaggcagttggaattggatggtgagcttgccatgaggctagagccattcatttcccagatgttaaaaacatttgtttggcccgggtgtagttggtcacacctgtaatcccagcactttggaaggccgaggcaggtggatgacttgaggtcaggagttcaagatcagcctggccaacatgacaaaacccctcctctactaaaaatacaaaaattagccgggtgtggtggtcggtgtctgcaatcccagctactcaggaggctgaggcaggagaattacttgaacctaggaggtggagactgcagtgagccaagatcatgccactgcactccagcctgggagacagtgagactctctctcaaaaaaaaaaaaaaaataataataataatatttgtttgttccagagggctgtttccttaaaactgaaagtgaagattaccaaattcagtttgacaaacaaagcccccgtacagttcacgtgccaagtgagagaaggcaggtgccagtcccagcatgtgtgtgtgtgtgtgtgtgtgtgtgtgtgtgtgtgtgtgagtgtgtgtgtgtgttttggaattcacaggataaatactgtggtacaggaactgtcaggcctgattaatacttttgcactcgcggtgcatgtgccttgatctataggcattatgcttgctgcgtgggtccctcacaaggcagccattagcatcagcttccaagcagctcccccactgtgcacttcccttccctgtcatatgcttggctgtcatctttgctaaaggattttcaggttggtttgcaataagggtaaacttgggaaggatggagagcaatttcctttgaatgctcaggatggtgggggctggttcttagcacacagaaaatccatatgagaatgcctaggacaaagcgggggaatgatttctgtatacggtgtggtgtttagtacgtgaaacccttaggcccccttaaagtcttccgctccaacccttaaacagttaagcatatagattagcatcacttacatgcaaggacattgtaaaatatgatatgtttacaaaatgctatggaacgctagatgattattaaacataatgaggttgaaatctaattccataatatgaagatgcccatgttttattcagtagaataagcaacttgtagagtaacataagtagtgtgttatctcattttttaaaaaaggtagataagtaccaaggagggcagatcactcgaggccaagcgtttgagaccggcctggccaacatggcgaaaccccatctctactacaaatataaaaaattagccgggtgtggtggtgtgtgcctgtaatcccagctacctgggaggctgagggaggagaatcacttgaatctgggaggcagaggttgcagtgagctgagattgtgccactgcactccagcctgggcgacagagtgtgactcagtctccaaaaaggaaaaagaaaaaagaagatagattcagatactgcaataatttggaagctttatacagcaattactaaccagagtttttcttttgtaagtgagtttaggtgaaactttccctttctacattgtaagttgctttattgtttgtagattttataacgaataggtaatatttttggaattcccaaaaaatattgaatttcccatgtaagataatattttctacagatcatatcattcagatcttgtttcttctaagtaatgaaattctgatgcatttcatactgcctgctgcaagtaaggatgtctgaaatggacaataataaactaaagatagaaagaatcccttctgagtcttacactggatggacttcctgccctccagccatctttaaatatcatgccaggtatgaagaattaacatccctgatttttcttttagaaagaatattggtatctgcctagaaagaagatggttattaaaaagaataaaagcagacctgctttttcctgcccagttaatctttaccgggacaggacaaaccaatcactgcggaatgttttgtgggtgtcctgaggctgctgtaactgagtatcacagactggacgacttagaacatcagaaatgtcttcgcctagttctggaggttgcatgtctgaaatcaaagtgtgggcaggcttggttccttctgcaggatctgaggaagtagcctctttccttactcctagtgatttgccccacagtctttggtgttcctcggcttatgggtctatcactccagtctctggctttatcttcgtgtggcattttccatctgtctctgacttcacatggccattttatttatgaggacatcagtcatattgacctagggactcaccctactccagggttacctcatcttaactaatcacttctattaataaagtgactctgtgtttgaaaatgtttgcatttggaggtatccggggttaggacttcaccgtatctttttgttgctaacagacactttaaaaatatagatgactgcatcccaattaccagtcgaattgttttgggcattatttattaagagaaataaccattgtgatgcataagatgatctgtgagccctgtgctgcagacgagggccatgtggatggtatcgtgaaaacagttgcacctttgcttaaggcaaactcattgtataaaatacagtttgcaaaacagttattttgtgggtggcctatttttccctctagaaatggcattttttactctataaaggaatgaaaacttcttatacagagaacttcccagtggatttagactagaatctcattcactggtgctaataattccaaaatacattcgtatttaagatcctcatgccagtaattctagtactttgggaggccaaggcgggtggatcacctgaggtcaggagttggagaccagcctggccaacatgccaaaaccccgtctctactaaaaatacaaaaattagctgggtgtgctggtgggtgcctgtaatcccaactacttgggaggctgaggcagaagaattgcttgaacccaaggggcagaggttgcagtgagccaagatcgcaccacatctctccatcctgggagaaagagcgaatctccatctaaaaaaaaaaaaaaatcctctgtcccaataaatatggccacaggaaaattcctcatttcctcaaaataaagaacttctttcacatgaaatgtccatgtgctttccatcagcctttccctctccaggagaacatcaatgcaaacacttgtatttccctcctttgaaagtctctctatatagcttccgtcttttctcatgcacgtgagaagtcagctctgccattaacagcagatggatggagacacagccgcatttcccttctcacaggcactgtctgcttggcacgtggaactgcgtttccttgctcgcgaatcctcatgtgatacgcatctccccatccctcataacctccctcggtgcagaaactatctgtgaacagtggtaccggtcccttgacgttgtagcttgacttgctgaactctgattctgaatccatatatagacgcagggacactgcccagttttgcgtttaggaaagtcagactgtcatcggtgtggagggctgtgcagcagatgaggacagggccccaatcccaaactgaagaatcttttataggaagtgtcaggcctttttgcaggagcaaatttttcatcattgtatgtgtatttaacttttctgttctttggtaactggataaacagtgaataataaatgaatgtctgtgctcatattctcctgtcctttaaaaattatattaacttatttttaatcagtttattagttatatgctatattacatgctataatctgtagagaaatccacccccaaccgtgcccagtgatagtgactcaaatacagtaaaaatgtttggtttttttttttttggccaggcgtgatggctcacgcctgtaatcccaacacttcaggaggccgaggcgggtggatcacgaggtcaggagatcgagaccatcctggctaacaaggtgaaaccccgactctactaaaaatacaaaaaattagccaggcatggtggcgggcgtctgtagtcccaggtactcaggaggctgaggcaggagaatagcatgaacctggaggcggagcttgcagtgagccgagatcgtgccactgcactccagcctgggcgacagagcaagactcaggtgatctacctgcctctgcctcccaaagttctgggattgcaggcatgagccaccatgcccggcaataagttttcttaattcattgcaaaaggcagggcttttctgacaagagtgagctacagccattattctgattaatgctgccataatctaacatcacggaatggcaaactagagactatgggccacctctagcctctgtctgtttatgtaaattaagttttattggaacacagtcatgctcatttgtttacatattgtctctggttggcttcctgccacgacagcagagttttgcaacagagaccttatgtcctggctttgaagatacatactatctgcttctttgtaggaaaagtttgttgattaccggtatacagtgttgatctttgagcagggtacttaagaacgtagaggtgctttggcccaccacgaagagttttggaagacgtaagacttaagtggtacaaggagaggtcctccatccctgactataagcacttgtccaccttgatctcatctgtatagggttcagtgaaacttctgcttggaaaaatacatgtttgaaatcaattacatgaagcaaatattgtctagagtgtgaaggaaagggaacctgatcttcctgcttggaggtctacaaagcctcaaaaacagataggcagttgcccttaacctatacagcagagacattgtgtatctaaaggcatggatgtccagctaggaattatgacactcatgcagagggacatgaggagggggtagtttgggtctgactctccagttcacttctcatggatgtaattgatttcaaacttgtatttttcctagcagaagtttcactggaccctatagagatgagatcaagatggccatgtggttatagacagggctggaggacctttcctcctaccacttacatgtgggggttccaaagatttactaaatgctttgcatgtgttccaggtgtcagagcccatcacaggcagggttttgactctcagggagcctgcagtcttgtggagggaaggtgggcaataaggaagaagagacagcatagatattttgtgcaatttcagccagaggaaatatggcaagacagtagacagtgggggataaagtacagcaattttcttttatttaggaagattagagaattcctccttgaggaagtgatgtgagtttcaataaggatggaaagtaccatggaggtctagaagtgtctgggggcaggggtaacagcaaaaacaaaacttttcaaacatggaggtggtgttggtgcatgctggtgtcttgcaagtgctttcagaaggctacccttatcttttcctatccacctggcaaatacctcctcatatgcatgcaagactttgctcaaatgcagcaatccttgtgtttgtttctgctgctctaggcgggaatcccatcccctttcttccaccttatcctaaccgtcagtgctcccagtgttacagggacatgaggaggggttagtttgggtctgactctccagttcacctcccagcaccctgcctagtggtctacccatcactgatacttaacagttattgaatatgattatgtgtataccctagaaaaataagcaacaaaaccgttcattgtaatagatgacattgactgaacacttacttaaaacgcagtttcaagcccttagcatatataaagccattcagtatgccaaataaccataaaaggtagggactgtcattatttatagaagaagacactgaaacacaggaagactagtgtgtcagaagtcctacattctgataatagtagcacacacttcctgatgttcattatacatttaccactaggcgtttaatgtggattttgcttataatcctcataaaagtctctggaacaaatgctgacatgatactcgtttcgaggaggagagaatcagaatacagaaaggtaaaatcacttctccaaggttacgtggctagtgcgtgagagaactggctttcaaattcacatcactttaatgtgatgtgttggtattagaaagggaaagcatttcaaaagccctcaccacagtgtcataaagctggctgctcatggtaaacattccaaagaatccaccaacacagtgtccttggagtccgtctgcgtgcctgtgcaactgcaccttgcttctcttggtgaaaaattcacctctttggaccctgtgttcactcttgttgttgtcctccccttagatgaggaaggagcagggccatccgtaaaaacagagtcatagggtgaaaacacatcacagagaatgcaaaagggttatttatagtccagagtgggaagctgaaaagacactgtgagaggaacttaatcgtttcccaggggatcagggagaagagtggacagtggtgatgccacgctgcagagggtcaaggttgcataccaattaaaatgacttccagacacttaacacacacatggtacttcgctacagaccgctgacatgttccagccaggaaggagaaaaaaaaaaacaacttctgatgtctcatgcctctgtcccccccttaaacagtgaggcagctgggctaacactgttgttgccaaacaactctaataatttcaggttccatgataatgagttggtggccttataactctcgtttgcatatcttggtacaagggaaaacattcagtccagtatgactctttaaatagccatctatgccaagccccacataaaaggtgggagggcttgttgatgttccctttttctgcaaactcatttgtgaaactacatcaattacagttcaatcagttctcccattcttttttcttctcattaaacttatgcctttctgcttagttaggagaggactgtaaactcagcttaagcaaaaataagaaaaataagaaggacttattcattctcatgaaacctatgcgtctaagggtaggagactgcctttttggtgtgcgtaaacctgtgcccctgagaaactctctgcttctcaaaactgctttcatctttgttggtttcctttttttttttttttttttttaataactttcattttaaactcaaggttacaaatgtactgtttttacataggtaaacctgtgtcatggggacttgttgtacagatgatttcatcatccagatggtaatcctagtacccattagttatttttcctgattgtctccctcctcccaccctccaccctacaataggccgcagtttgtgttgttcccctctgtgtgtccacgtgttctcatggtttaagtcccagttttaagtgagaacaaggaatatttgattttctgttcctgcgttagtttgctaagtgtaatggcctccacttccatccatgttcctgcaaaggacataatcttattctttcttatggctgcatagcattccatggtgcatatggaccacattttctttatccagtctatcattggtaggcatttaggttaaactgaaatcataacaaacagtctcttgcaccacagcataactaaattcaaaatcagtcagaattcactcaaaaccatacagttacatggaaattgaataacctgttcctagatgacttctgggtcaataatgaaattaaggcagaaatcaagaagttctttgaaactaatgagaacaaagataaaatataccagaatctctgagacgcagctaaggcagtgttaagagggaaatgtatagcactaaatgcccacatccaaaagttagaaagatctcaaggtaacaagttaacaacacaattaaaagaactggagaaacaagagcaaacaaatcccaaagctagcagaagacaggaaataaccaaaatcggagctgaactgaaagagatagacacgaaaaaccattcaaaagatcaatgaatccgggagctatttttttttaaacaacaacaataacaacaacaaaacaaacgattagctagatgaataaagaagaaaaggtagaagattcaagtaaacataatcagaaatgacaagggggaatattacccctgggcccacagaaatacaaacaaccatcacaagattatgaaaccctctctgcacataaactagaaactctgaaagaaatggataaattcctggacgcatagatcctccccagactgatttacaggaagaaatttgttttactttcaagcacgttctcatattgtcaccaaagctccacacttaaaatcccttgtattagtttgataggactgccttaacaaattaccacaaactggtggcttaaaacaacaaaattttattctctcacaatttgagaaggcagaagtctgaaatcaggatgtcagcagggttgattcctactagaggcttggaaggagaatctgatccttgcatctcttttagctccaggggactgccagcaatccttggcttatagccacatcatttcaatctctgcctctgttgtcacatggctgtattgtctgggtgtctctgtattttaaatctccctctcctttctcttataaaaacactagtcaggccgggcgcggtggctcacgcctgtattcccagcacattgggaggcctaggccggcggatcacaaggtcaggagatggagagtatcttggctaacacggtgaaaccccgtctgtactaaaaatacaaaaaaaaattagccaggtgtggtggcaggcgcctgtagtcccagctactcgggaggctgaggcaggagaatggcgtgaacccgggaggcggagcttgcagtgaaccaagattgcgccactgcgctccagcctgggtgacagagccagactctgtctcaaaacaaacaaacaacaacaacaacaacaaaacagtagtcattagtgtcaggctgtaccctaaatcaaaaatctcaagaggcttaattacatcggcaaagccccttttttccaaataaggtcacattctcaggtaccagggactaggaagtgggcatatcttttcgggggcacattgtaattgactacacatattactgtatcaaccccattgcaaacagagcaaaccccagaaatactgggctaatgctcgttagctctgatcacctggcctgactcacagatcaacctttaggctaatcactgcagctagaaggacatgtggcaaccccagataaagaacataccatttaaagaccacacacatcacacaaaacctattgagagacgcttgacgaacaaggtttgtgctcagtgtgttaagtggatgacatgatttaaaaaaaaagtaactgaagagctaagagagagttatggtggaagaagtcgttacacaaaggtgctacataattgctgctaggttcgtgttagccaaaggggcttacaccattttcaagcctttacaagacctgagagtgatgtgttggtttgagttggtgtttatgtggaaagggaatatgtatggaatattattaaatagttttactgaattattggcatattgtaggcattccttaagtactttattgaatgatagcacaaaatattgctgaatatttttgctacattcttggcaggttgtaggcatctcttaagtatagttctgcaccacataatgacgtttcagtcaacagcagactacatatatgactgtggtcctataagattataatggaattgccctatacagatgtataattttttatcttttatatttttatcgtaccttttctatgtatagatagatttagatacgtagtacttaccttttaatgacagttgcctacagtattcagtacagtaacaagctgtacaggcttgtagtctaggagcaataggctagaccatatagagtgtgtgtgtgtagtaggctacaccatctaggtttgtataactgcaccgtgtgatgttgtcacaaggatgaaatcacctaacgatgcatttcttagaatgtatcctgactcttaaagcaacatttgtggtttattgactgaagggataaaaaataaataaatgaatatatgaatacaaaacaatttttagaagataaatgaatgagtgagcaatttgtccttctctttcctcctgagattttctatttttaaaagtgtgcttgtatttttgtctttatatttaaataatgatttaaatgatttatttaatactgaagccactgatgagctgagaactcataacacattgctaggcacagagcaaatgtgaaatttagtttttgttgtttttatccacatgttgttctgccaagttgggcaacataatgccccctcagaatgctagttaatgcacttaattctctcagggtcttcttactttagactctttgacatccttgggcaattaaagattagctattttaatgaacacaccacatcttttacaaagcctctttggcaaaagacctttgtcagtccgccatcgacatatattgcaaattacctgctgtgtcccttgaagtattatggaaacgggaaacatatgggtggactggcacaggctctgcataccccattccagaagcttacattgtagtaaggcaatatcaaaacatgcatgcaaatgaattaggttagtcaatttgagattatctgggagggggctgcttttgtgcacaagacagagctaacctggaatttgaaaggtgcagttgggcttagctgtttcagtgacagtggggagcagagatgctgagaagggcctgagaaggacagtgaaacccaaatgacagctcaagtgttctgattgtcactttcatgcaacccctggtactgagtccatgctgcatattgttaggtgaaaattctttttttttttttattatactttaagttttagggtacatgtgcacaatgtgcaggttagttacatatgcatacgtttgccatgttggtgtgctgcactcattaactcgtcatttaacattaggtatatctcctaatgctatccctccccctgccccacaccccacaacaggccccggtgtctaatgttccccttcctgtgtccatgtgttctcatcgttcagttctcacctatgagtgagaacatgcggtgtttggttttttgtccttgcgatagtttgctgagaatgatggtttccagcttcatccatgtccctacaaaggatatgaactcatccttttttatggctgcatagtattctatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtagtgggattgctgggtcaaatggtatttctagttctagatccctgaggagtcgccacactgacttccacaatggttgaactagtttacagtccctgttaggtgaaaattctatggtccatttcacaactacgtaccacagaaaagggagatacggacaacactggaaaaacaaaatataagtatgcaaaggaacacagacttggatatgaggaaggggcataaatgctatatttaagcacatggttactgcctttcctaaggagtaagccaggaaaagaaactttgggtcagttaaatatctcgttgcttcctttgcaaaagtaccttttaatagtctgtttttagagttgtttaaaaagaaaaaactgtcccttgcctactttaaattcttgacatttttttctggttttggtgagatcagggtttttgcagggcagtatccttcattatatatgtcagaaggctgagaaatgagtggggatggtgaatcaaccacagcccttctgaatttctcacaaggtaatctacctaacagaacataccagtttccacccacctttgttttggttagagtgatattttgtcccttggcagtgaggacgtctttccttcacatgatttttgtaagactgtaccctaaaagtagccacagtgcagctgtgttttatatgaaaacaaatggggttttgttgggtacattttgtggcatttcttgaggtcaccagaaactcctagacgtcgttgtaaaacaaagaaagaagaagaaaaaggctggaaactcactcctcctgctgttcttatgtcaagtcagtgaaggcaattctttaattttttcattttttcagtgaatacttagcacataccatgtataaccccccatgtaagaccagccctttgtcttctaagaaatgacattctgggctggacgcggttgctcacgcctgtaatcccagcactttggtcgaggtcgaggcaggtggatcacttgaggtcaggagtttgagaccagcctggccaacatggtgaaaccccatctctactaaaaatacaaaaattagctgggtgtggtgtcgcaggcttataatcccagctgtttgggaggctgaggctagagaatctctttaacctgggaggcaaaagttgcagtgagtcaagatcgtgccattgcactccatcctcggccaccaaccctatctaaaaaaaaaaaaaaaaaaaaaaaaaaaaggtattctggtggatagtgggggagtggcacacccccaaaacaatttcacaaacaattatttaattgcagttgagttaagtgctaaagtgagaaggacacagaatagagtcgatttaaattagaaagaactaaaaaatgtagctaatttcttcattcctgtaactctgggtttgagacaacaacaatttgagtgaatcagtgaatgactgcatagatggcatgtataggtgtcaagtaaaaatcgtcttgtagctaaatcctcagttgtgaaatgggatacaaagtccaagctcctttccttttctaggtatttctgatgggattcactcagttcgttaaaactttaagaaagccctctctgtctgttatttttctctctgcctactcagatggttcctccattctaactatggtagaggccaaccttgtcatgattttcagaactatgtagttccccaccgcccccgccccaagaaatgcagagcaatctgccttatcagtatctcttccaattaatgtaatcttgtttctgttatttccaccatatttttcaatccagtgagcctcattacatttgcaagtgcattaaattagagcctctatagaaggagaatgatgattatcagctaatttaattatgtttctacatttgcagcatttaatgatgtctgccattgttgttggggattcttacattggctccaggtagaaattagctctgatcccatgtaaagtttacgttatcagataatacttgagagctcattgaggtacatgttcagtaatttttgaatctaatcaaaattgatttatgtgcaatcaaattataggaataaagaaacagcttcacctaatttagttgccgattatagtgttgcctgcctctgaagtcacaccaatatgcgtctcttagttttgtaccaacattgcatcaaggcctaaaattctgcaggtttttttttttttttttcccaaattgcatagttggttctgtatttctgaccttctgctgtccatcagattgaacatttatgccctctgattttgtgtcctgttcaacaaatgttgcccgggtgtcctttaagtgttggccatgtgactcttgcactagaggcccaggtcacccatgaacctagaagagaagatccatggtgtggaggagtgggtgttgcaggacctgggagctgaggctcgggagggctgattcatcattcttcctcctttgctgtggattctcaaccaaggcaaaaatagatacacacactcaacagggattaaggtacagaattcacgctgggcatggtggcttatgcctgtaatcccagcactttgggaggccgaggcaggcggatcacctgggatcaggagttcgagaccagcctggccaacatggtgaaaccctgtctctactaaaaatacagaaattagctaggtatggtggtgcgcacctgtaatcgcaggtactcaggaggctgaggcaggagaattgcttgaacccgggagacagaggttgcagtgagccaagattgcaccacagcaccccagcctggatgacagagtgagactccatcttaataaataaataaaataaaataaaatagaaataaaataaagtatagaattcagtttatcaccagtgaggctgtgttgtaaacatgcttttatgtttaacaagcactttagtcatagttattttgtgccagacacaaattggaaggaccttatacacaaaggccctttgaattgttatgatagcctaaatacaaactattattatcctccatgcacagtttatagacgaagaaactgaggcacagaaggctgggctatgttgccgaaggctacccatctgccttctgaaagaaccagggttctagtcctggcggtctggctctaaaatccatggccgctgaacacaaagtcctattgtgcctcccaaagctgaaattagcattctgtcatccaacccgcattactcctacaaccatatctagatcttgggatgggcagagtagtttggaggatattggtccagcacaggggaatgagatggggctttgaagctggcctctagaaggcggggccctgaaacgtccctacttaggtgtgcttacctgttctaggtataccttacctactctaggtgagcttaggacatacggatcaaaagcaaaacatgcactgcttggaggaagtgagacagagaaagagagatggagagaaagaaaaacttttccattttgaaaagttacccatcagaaaagtctctatgatgttgattgggtgaggaagaatattggaaacttgctccctgaaacagtcataacacagtggaggatttgagtaagtctctaggtctcaaaggaggaagcaggaaggatgagaagataagaactatgaacgctagactgagaatatactattaacgcctatacttaagaatataagatgttcttgagacatgtgataaagtaactttccagaaaaatgagcagcacactgtgaaaacaaagacgcaaaagtgaggtgtcagtcatcccccctctgaggccggagggagggtggagatttggtgcaggtcgaaactgaagccaattgataaaatgctgtgtgtgccctacaaggaagagagaaggtttgaataaaataaagtgtgtctcagtacaaaaggagaagtttcacaaagcatttagacatcttataaaatggagttgcttcatcactccctaaaggggccatcctcaactgtctcctgttcaaggcccactctcagcctcgctggatgtcaacagccataaccatgtgattgttactgcagcagagcaatgtctccaagtgtgcaaaggacatctctgggtcactgagcgtgaatgtccatgagcccagccaggctcccttctctgttcaggaggcaaagtttttccacttcgcagtccccaagatgtctctgtgatactggtatggcgttaccttctgcctcttcctgcttacgggtaccttggtcatctcaccagtctccctgggggttagcatcttaggaatgtgtactcaatgacagccaacgtaaattttgcaccttgctcaaaatttgactgctttcccgttaacggttcattaattgaaaactaccggtatcttcctaaacctagagtatgtcccaacagcaggatgtgattttatgttttgtggtacatggacatgcattttgttgtaattgcagatgtatatgtatgaggctggttttcaaatatagaaaatatgaaagaatcataatatactatatacccagcattaagatgttacaattcacatttttatcatatttgttttatctcttatatatccatcacttcatctaccaatccacctcattttgtttttttatgcatttcaaagtgacttgcatcagtatctttcacccttcagcagggtgtaaatctttaatgagagctcatggtttgtttgtggtcttttatttttctgaggtaaaatttattgatactgaaatatacaaaccttgaagggaccgtttgatgaggtttgacagctgagtacacttttgtaacacgaagctctgtgaagatatagaactgtcattcttccaaagtttaggtatgatctgtatgtttattagaaaaagaatcacagcctgaccagtatggtgaaaccccgtgtctactgaaaatacaaaaaattagccaggtgtggtggcatgcgtctgtagtcccagctactagggaggctgagacaggagaattgcttgaacccaggctgcggaggttacagtgagccgagattgcaccactgcactgcagcctgggtgacagagtaagactccatctcaaaaaagaaaaagaatcagcatacatactaaacctatgattccatgaacagtttaaatgaaagagtacatacttttgtgtgtgtatatgtgtacctggttacatatatgtgtgtataatttacattgataagaataatgcagtatgcagatgtagcagaatttgtaattgtgatggaagttcttctgtatttggcaattacaggcctagggaaaaggtaacctcatcccattagcattgtcttcaaaaagaacacgagcatataaaatgtgcgaggctacactgatgtaacgtccaagataaatggaaagaaacacagtgttgctcgtttaattgaggatgtttaacgacttttggccctgagagtaccaacagctacaatttttcaaagtcagccttgatttatgttttattttttaagtactcattaatgtcacaaatagttaagttgggatcagctgtcttcatttacaaaaaatgggttatactttcatcttttgaccctgaaacgtgtagataaaaatcaacattaattggcaggatgaatgagggtggttagggtgggtgtctggctgcaagattcttagagtattgggagagatgctcagagccccttaactggagatgacaacgagattttaattaacagcaggtgagtcttgtggtcagccatttgacatataggtggatcacaaaatagcctttcctttctaaccacatttatttctagcttaattagtccttctgagatagcttcgctattagccacagcctctccatttaagatccttttaatcagacgttttatttttttattttttattcttctcattttagcactagcttaatgttatgaaggacctggactaactcattttaatgacctctgctacataaatgctaattttacatttggccttatttcggtaggttttttttttttttaaaaaaaaaaaagaccattgctttcagaaggagaaaaatggaaagattaaaccccttagtgtcatctgcctgaaaaatcctgtggtttcttctgacaggaagagggttttcaaatccctccttggtctaagcttctgtgcttgacatctcattattttactcagctacttcagcatcaccttcacccagttaattaagtaactcattgaatgtattattcagttttgattcccctgtctgtgacagagagggatggaagatgcttcttcatccttcttctcctgcctttttctcttctgcccacacccaaggaatggaaaagagaaaggagaggagagaagacattaatttcaaaatccatccatccatccatgcatccatccatttctgcagcagattgtttgatgtttttaatgatactcaaaagaaagtgaagttgatgatggtaaggttaatggtcataggtcttaatggtgatataacatcagtttgcaccaggcactgttaaaatttccttctaacatggtcttatttcgtacttaaaacagcctgatgaggtaagcactattcataaggccactttacaggttaagaaagctaagatctagtcaactaatttgttcaagtctccttgctagtaggaatcagaaacccaatttgggcccagaactagctgattggtaatacttatattccctacagcatttctgttaagtatctccatgtttgtagtcaagtttaaattcctaaaatttaagctggaatttatgatgaaaataccatgagaaggaggttgaaattgtagttgacctatgttacccgacctgctcgttacaggagttaagaaagaaacttgacttcctctagggcagtagtcctcaaaccccaaggaccaggacatttggccaaacagctatgataaatgctgctttatttgagtacattagacttcaattaaaaaaatgttttaaagtaccttattgaatgcatttagatttgggggagggaaggaggctatacttggacctaactccttggttgtcaacccagctggaaataagcaagacatgatgtttaatatgaatgaaagtagagagagagggcatttggaggggggttggtgcagagggaagcagaaagaattactaacatgaaaaggcagatagaaaatttagaaggtcaaaggcagagtaattgaaatagagcctcggaaattgtgaatctgagaaagaactggaggttaagtgataggtaagaaggaagataaggacaagtaaagggatggaataaaaccaaaaatggggggtgagtgtgtgtgtgtgtacgagagacagagatgcattttaatgcatatttaagaaaaaggaaagtagaaccttataaagaagatgaagtagaaatattttttagaaaacactttttattatgaaacatatttttttttttgtaagggaaagttcccagtgacagagtgagctgtgtagcaacgtgtgtaaaaagcagacatcacattcttaaagttactccattcgctcctgaacaaatattaagtggaggttttgttctgggtgtcagaatacagcatggaaaaaagacaaaggaaagtctctgctttcatggagctaagaagctagttgatgtggagatagaaaaataaacaaggaaatcaaggttatcaatgcaaataatggtacgtgcaataaagaaaacagaacagagaggataaagcattgctggctgggggaagagctcactgatgagctggtgtctgaactgaccttggggtagggaggaggagcagccaccgggaggctcagagcagcagctctgcagggggcgggggtagagcgggtgcatgcaaacaccccaaggtggccacaaacttaatgcatttgagaagctgtaagaaggtcattgtagccaaagaggagtgagcaggaaaaggtaggagaggtcagtagcgaaatgggcaaagagctatgttgggagctgggtttattctcaatggaaggagaggccattagggtttcaaatagagaaatcacactctatttggataatgtttggataatgtttggacaatgtttagtaaggatgtgctggaaggaggtgctgggtttggtttctgagtctgtcccttgttaattgtgtgtcctggacacagttactgcatctctgtgatccttcacttcctcctccttgaagacacttaactgcatcgggtttctttagaaggaaagctggaagaactttagagtctgttttccctgcatgctagctacaaactgaaaccatcgcaaacaacaaggtcaaaacatctgtgaaaccttgcaccagttgtaataaagatagccagggagaaagaaaaaaaaaaaaggtctgaacttgttggagaaacaaaaggacctcataaacagtatggagaccagttgtgtgttgtcatcagtgacttacctgagaatgatattcctgtggttatgaggatagtgttacagtatttccttggctaagtgtctgtggctgttatccatgtgcagaataaaagtccacttgaggaggagacagaggctcctgtcttttaccaatgttgatggatttcagtggaacaaaaatgagtctcttgaggttagaaggcaggcctggccatgggtgttttgcttgagctattccactcatgacactgggcctgactgatatccggcgaaggccttctttggctgaagtgcttgccaggcctaaccaacctggaatttattgataaagcttaagcagccgcaaggcctatgacctcaaagagtgacttaggctgactttatcagccttggctcttcttttcattatatttgctattactggagctgctctcttttcttaaaacctgttaaccttatacaaggggatgggaccatttgagctctcagacaggatgctgatgggaaattgtaagccttcgaaataggttgagagcttcctgttgtttgggttctggcagaggttacaaaaataaataaataaatataaaaaggagagggatggggagacattgaaaaataaatacttgatgtgttttcctggagttgagctggcttcttcctgggacatgcttttttccagcccttggaagaaagttgcagcgattgtgcccacttcacagatgcagctgacgtgcacccctgtgctgcgtggggatcttagcagggcaggtcagatgtccagaactacttacatcctcacatcagtggcttatagaccaagaaacagtcctctccaataggtgcacagaaagtgttcttgagtctttatttttattttattttttttgagacagagtgtcactcttgtcgcccaggctggaatgcagcggcacgatcttggctcactgcaacctcctcctcccaggttcaagtgattcttgtgcctcagcctcccaagtagctgggactacaggcatgcactaccacacctggctgatttttgcatttattattattattttttttagtagagatgggttttcaccatgttgagccggctgatcttgaatacctggcctcaagtgatccccccacctgggcctcccaatgtgctgggattacaggcctgagacactgcgcctggccacatgttctggagtctttaaatcaacagactgtttaacttggctaaaggaagtcaagtagttacttggtttccagccagttactgatggctgtaattagccacatgttttagtgactttggaatcgaggctctagccaggcgctgtagctcatgcctgtaatccttaggctttgggaggctgaggcaggaagatcacttgagttgaggagtttgagactagcctgggcaacacggaaagatgtatctctataaaaaaataaaaataaattagccatgcatggtggtgcatgcctgtagtcctagcgactcaggaggctgaggtaggtgggaggattgcttgaggccagggggtggaggctaccataagcgatgaccgcactactgctgtccagactggacaacatgagtaagaccccatctcaaagaaatccaggctttgtgtaaaccgatgcatttcttattgaataaacctacacacacacatacacacacacatacacatacacatacacacagactatatctatattctactataccagttattgtgagtaattcatggaggttcagaatgggtagaaaagtcaataaacagtaaagttgccttctgttgtgtgctcattcactcttccattaaaaaatatttctgttactcctttaagaaaatgattagtgcaacaggaaagcagattggctgagtccctcagatcacccgcttctgagtcaaaccaataaggttcatgtcccagatccaacaactgtcagctctgtgaccttgggcaaaaaaccaaacctccgtgagtatgtttactctaaaatagggataatcactgtggctgcctcccgggcttagtgaagttgcatatatatttaatataatagatgatacatacttatataatattatatccatttaatagaatatatgatatatacttttatattttttaatttaaatataaaagtatattacatatttaaagtattcaaatatataatattaatctatgtaatatatgattaaagtattatataaatggaaattacattatataatacaaatatatgtatatatgtaaatatgtacatatataatacaaagatacatatttgtattaaatatataatacaaagatatatttgtattaaatatacaaagatatacatatatttgtactaaatatataatacaaagatatacatatatttgtattatatataatacaaagatatacatatatttgtattatatataatactttaaatttaaattcaaaatatatattataaattaaaaatacacatgtatatattttaatttatataatataatataatttaaattagtaatttagtttataattattacatatattatacatgttttaatttatatataatgtaatataatactttattatgttacacaaattatatatgacatgcatattttaatagtttaaatatatgttatatattttaatttatatatcatatatattatatataaagtattatatgtaagtatacattatgtattatattaaatgtatatgatatgagtataatatattacgaaagttttaatatatattacataatatgtacatatttttaatttaaaatatataatactttcaatttatatattcatcactaaaaatgattttttggaacattagttcttgttgttaaccttgtctctgagtagctgataacttcatgaaaaagtcagatattgtataaaatgccctgtaaatataagtacaagtgaaatcatttccaccatagcccatgatccttatccatgcaggaccaaagacttggtgccacaaggaacagtcaaatctggatggggaggtagaggaggaagtgataacaggtttggtaaacagataattgggcgaacagagggaaagtgattcagcaggaggagacagtgagccaagtttctggaaaataaaaagaggtatcaataaaaaggttgacagggagcatagggtctgggaggaacatactagaatatgagtctaggaaggaaggtggcataggcacagaagtaatttcagtaaatccaatgagtcttacggttttgtgaattcaaaattatttttggaaaatcatgctgcctaagagagatcaatttatttttatttattttacccaacataaactattttgatgcacttgaccagtcagtcttagggtttaggtcactatcatattcacctgaataagtatagtctgactattccttttattcaaaatgttcgagaccagaggtattttggatttcagatttctttttcagattttggaatattgacacatacataatgaggtatcttggggatgggacccaagttgagaaccgtcattgccttatgctttatatgcacatcatacacataacctgaaagtacttgtgtacatgtttaataatttatgcttgaaacagttttgagtgtattttgactgcagtccatcatatggaggtcgggtattgaattttccacttgtggcatcacctcgcatctcagcagtcagacagttttggatttgggggcacttggatttgggattttttcttttttgagatggagtctcgctctgtcgcccaggctggagtgcagaggcacgatctcggctcactgcaagctctgcctcccgggttcatgccattctcctgcctcagcctcccgagtagctgggactagaggcgcctgccaccacacacggctaattttttgtattttcagtagagatggggtttcatggtgttagccaggatggtctcgatctcctgacttcgtgatcagcccggctcggcctcccaaagtgctgggattacaggcgtgagccaccgcacccggctggattttggatttttagattgggagtgctcaacctttaataacaatattaaaaaattattaaacctctaattactgtagcacatatcagaagatttctcttttatttggtttaagttattttggagaaataaaaattgtattttttgtgtgcatgatcttttgaaatgtgtaaacattgcgaaatgcctcaaccgagctacatcacataaacatttatattctatttgattgtgtgaatctcaccaatctggaagtcataaaataagccaattatatataatatagtttatatatataatatataatatatataatatataatatatgttatatataatatataatatataatatatgttatatataatatataatatatataatatataatatatattatatgtttaatatatttatatgtttaaatatatgtataaacatatatgtataaattatgtataaatatacataaaatatacataaaatatgtatattatgtatatttatgtatatgtatcattatgtataaaatatgtataaatatgtgtataaacatttatatggataaattatgtataaacatatttatatgtataaatatgtttaatatatataatacatattaaatatatatattatataatatataaatttatattatatattaaatatataatatacaatatatattatatattatatatattatataatatacaatatatattatatattatatatattatataatatacaatatatattatatattatatatattatataatatacaaatatatattatatattatatataatatataatatacaaatatatattatatattatatatattatataatatacaaatatatattatatattaaatatatataatatataatatacaaatatatattatatattaaatatatatattatataatatataaatatattatataaatatatgtaaatgtatataatatgtattatatattatatataatatcctatatattatatataatattctatatagtatatataatattctgtatagtatatacaatctgcatagtatatataatattctatatagtatatatataatagtctatatatatattagaatgtgcatttaacttgaaaaggttgaaactctaaagtactccccagataactggtggtgaattgggagccagatgatgaagtggcagcagaaagtacagctgaccatgagtacagggtctagaagaatattgtaatacatctacatctcttcaagaacacaacaagttggcgttatttagcaggagggcaggatattccatggtctccaaatcttggaggtcctttctgcactggattacaattctgaaactcatcatccatatttagaaaagtggagacagtgaattacattttacagggattttacccaaaaatggttaaaatgacaaagtctctgtgcttcagtatattagccttcataattttcaacacccaacatttagttttttatctcattcccaggatgacatgtttgactgaagtatctaagacacctttaggggtagactaaacttctgccactctctcccaacaaaatatctgtgtcatatgaatgttgtaggcctgccattgtaaaagagaaagtaatcaagactttaatgggattatttttaattgtcttcttgcatataaaaatgaaatgacaggttctgaaaggaaacttggcatttgggaaagagggtggaaaaaccagacaaatgtaattatcctaaactgttttaaggtacatttttcctatgctcatgtaagaattaaaattagtgttttaaagaataagttactggtaaatcgcatggcaaaagaacatacatgttcattttttcttccttatttcaattttctgagaaaatttaagtagttatttctcaggtgagttttaaaattcatccttagagattggaaactcaagggccacgcattgagacttacacatttattataataaaatatgcttctggcatattaacttttactaccatgttgtcaaacttagaaatattgcagtggaagcaaaaccaagaaaatggctatcggtatgttctttgatgaatgaaggtgtgtacacatagattgaacaaattttttacactaatttatataatgtttagccctttaatgccaaatattacacatttaatgttgtcttattacgagcactcattccggagtacaaaaaattgagaggaaaaacaaaagagacttctcttcgctattgtaactccatgctggtttggttggtgcaggtgtttgggtgatggccaccattttggtcttgtcagttacttaaggctgtagacaataaaggttgcattcctgaaataaagagttggttctctaatcttgtggaaagaaccagtattcattttctaccaggaagcaaaatgccaaggtcacagggacagaaaatattgcttcccaagaaactgtggttgacaagatggctcgagttcaagtgaatcctgaaagtatcagtttccaaggagacctgtggccccacccagccacctacaaagcttagccatcgtttcactcagagcagcagccatttcttgcaaactggcagctcatttctggatactcaataggatgcataagaatgataaatttttttcaaatcatgtgcgctagctctgttgaccttcagctgtgctgcgccttctttaattggcataaatcttggactgcccattggatgtctttctggaatctgatgtctttctgtctatctgattcctaagaggaagtgaaatattcaattaaatagtttcgttgagtccttgtagtgctaggatctttacaagagcggtttagtaggtgttgagatagactatctatcagcttcccttcccaggagaacgtgtcctgttagaaattgcatcttttgtggccagtaggggtctgtttaattgactgaaatagtaatgacccggaggaattaagacagtttttagaaacatcttatattgagaaggaagaacaataactatgataaaattatacaaatacacaataataataaatacacataatttaaagattacaattgtgggccgggcacggtggctcacgcctgtaatcccagcactttgggaggccgaggcgggcggatcacgacgtcaggagattgagaccatcctggctaacatgatgaaaccctgtctctactaaaaatacaaaaccaaattagttggtcaaggtgttgggcgcctgtagtcccagctactcgggaggctgaggcaggagaatggtgtgaacctgggaggcagagcttgcagtgagctgagatcacgccactgcactccagcctgagcaacagagtgagactgtgtctcaaaaacaaaaaacaaaaaacaaaaccaaaaaaacaagattacagttatgacaggtattttgacccctaactatgtgtcagcactctgtatagcttatctcagtactaacactaacacccatatgatgataccagagcttttaaccccattttctgaaatacagaaactaaagaacagataagttgctgcgaaaagccatataaatattaagtggtagagtcaggattttaaacagggtacactggtttctttcttaatgtattttgatccacatctacaggtgaaattcaaatgcagcttattgaattttctctcaaatattatggtgaattattttattatcttagtgtttcagatacgccttttgccacatttcctcaagaagttgatatactattaagaactaggctatatttttaattttttgttaatttaaatccttcatagaggccgggcatagtggctcacatctgtaatcccagaacttggggaggccgaggtgggcggatcactggaggccaggagtgtgagaccagcctggccaacatggtcaaaccccatgtctgctaaaaatgcagaaattagccaggcatagagcaggcacctgtaatcccaggtacttgggaggctgaggcaggagaatagcgtgaacccgggaagcggagattgcagtgagctgtgatcatgccactgcactccagcctcagcgacagagtaagactccattgccaaataaataaataaataaataaataaatactactttatagagccagtgtgggaagtaggtacattggggtatatcacatataggaaacactgggcaaatacttgtgaccctctagaaaggaataaaaaaactccttctgaaggatacaagttccagttctggtttttccttcagttggccttgaaccagaatacgttctctgggcctctctgactagtccctgtcatgttctagccccatcttaggattaaggccaagacccaaaacaagcaacatgaacatcagaacagcaccagaaaccccaggtaggcttcgcagatgaaaataatgactgtggcagccatgctactcaaatggaaggcctgctttctttttagaaggaacctaattggcaagtaagttgctatctgacttgatgggcgtaaactcaccgttctgcatcccactttcccgatcttcacttcagttgcttaaatggagtgcactaaacctcaatttgataattgcatcctcaaaacctttaatgaaggtgcctatcaaagtgtaaataattaccccgtaatcttgtatttgcaaactgcatcttggctgtttacgcttcaccgaggttcaaatcagaggttcagggcttccccagccctcacattcctgttgacgtcagaggaatttcaaggacctagaggacagcattgtaacacggttcaaccaaggcgttcaccttcactccctcccaacgctgacatctgtcattttctggtgctatttataaatccaagggagcattgctgttttgttttggtgctggtgatgcagacactcatcctcattagaatttttgccctgacgccgggcacggtggcccacacctgtaatcccagcactttgggaggccgaggcgggcagatcgcttgagcccaggagtttaagacaagaccaggcaacaaagtgaaaccccgtctctactagaaatacaaaagttagctgggtgtgatggtgggtgcctgtaatcccagctactcaagaggctgagacgggagaatcacttgaacctgggaggcggaggttgcagtgagctgagatggcaccaccgcaattcagcctgggtgacagagcaggactccgtctcaaaaaaaaaaaaaaaaaaaaaaaaaaaaaaaaaaaaaaaaaaaataggttctgccctgagcctttcaggcctggccttgttgctctgggacttgctccctcctcgctaacgtgtttccttctttggagattacccactttagctcacctggggaacacacacaccactgacccagttagggcttcttccagcctcttctcttttttccattcttttgactgcgttaattattcacaggaacccgtcaatgaaagcaccagggattatccaggaggctgaccaccaaattagaacaagaaaatacttgaaacagtttgcatgctgtctgagggtgcagctacggagagggtatgttttaggtgctggggtctgagagaaatgaaaagagacgccaagccaggtgactgacagaaggcaggcgacaaacccaggcttcccaggctcgtactttctcttcggtgctgtatttttcagcacacaaacttgctgagagtttgcagctgacatctcgagaagtattcttcttaaaagctgagcgaaaattattcacctcatgtgaaaacaagtgcgatttacatctaatgtgggtaattacttttacagttaattaaaagcgctctcattaaactcccgctgtgatgccaatgcatagctcttatttgcaaacagacctttggtttgagctcacctggtgacaggagactcctacctgaaacagggatgccgttctcggtactatgtttaattgtgctgagccagcaaccctcgagttacccggccttttaccccacgccagctctgcttgtctgcatggctagattttgagatatggaagcctcttgtcctctcataaccacactccaaaaaaaaagtaaggtgaagaaaacaaaataactcacaggaggtagggatgccaaagaaaggtaggggactcaaagaaagaagtcaagatgaaaagcctgctgtctttatttgcataatagtttggttggggatcgttttgtagttgttctggctttacagctttttcctgcctaagaagatatttactgtcagagaaaatatccccttaggccccctgaagattcctccaaatgtttataaagtcagcagctctgccctgcaacctacccaactaaggtaaactttactcccttggttgaagtgatttgtgttgagattttacttagtttacatgcgttgtttgctgtttgtatgatttcaggtgaaatagctcttacatcgtgagtcatcttcatatttaggttgaaaccatagacttttcggaatattctttgccctgaagcatctctgccacgctgaaccttcttaaacacatattaatgaaatgtctcctcaaatgatcacattcctagtaagtaattagggcttagtaattaaaacatgcagtcatttgagacttaaattttgaaggcacagaaagattgagaaatttaaaaagtttacggacctgatgaattggatactcttgcataggacttggtgctttcggtattttttgcaaagttatttgctcccatctgctggccatttgtgatattgcaggtgctgagctaatttgtgaatggaaaaggaagtgaataaaatctatcactgcaaacattttatactattcttcatgtattcaagtaaactgatttgaatcttggtttttgtttgtttgttagttttgttttgttttgttttgtttttgcggttggaggattaagtgaacacagactctgaagaattctgctgaaaggcaagcatgatttgaaatttttaccaacatcagagttactcaagttttgaaagccagaacaccctcgttatctttaataaagcaattaactttagaacattggtttaaatattcaaattcaagcacagtatattgtgtaagggagagtataaaatacatagctcgtagaccagatggatttcaatctcccttatgcttttaatcatcggagtggtaggaagccaattccctacactctaaaactcagttttttcacctgtaaaatggaaacactgggcaaaagggtccctaaggcttgaacttattctcaaaatctgagtctttgtgaaggttaaaaaatcatataaggctgagcacgctgggtcatgcctgtaatcccagcactttcggaggccaaggtaggtggatcacctgaggtcaggagtttgagaccagcctggccaacatggggaaaccccatctgtactaaaaataaaaaaaatagccagacgtggtagcatgcacctgtaatcccagctactaggtaggctgaggcaggagaatcgtttgaacccgggaggcagagtttgcagtgagccaagatcaccctactgcactccaacctgggcaacagagcgagactccatctcaataataatagtgtaggttgcataaaatcaccagtatgctcttagtcttagcatctaaactcatattcagtgacttgtcttaaattagaagccgttgttattttcacaacaataggcaatgtaagcatgcatccaaactatcagaaagcttgcctttgcaaaggagaccatctgtaatgttgagtcaagatttaaaatgcaccttgaatgctttttggagtgtgatgtcaaaaatgtatcttgtgttaatattataaaccgttctgctataacatttatttgctgtttaagaaggaagagcaaaaccttcttcctcagcagtaatcaatttctcagttgatcataagccgatttgggcttgtcagatgaacctttgactgtgtctcctcacactcctgagaggtggcttaagctgtcctgtatttcctatgaaaagctctctgggactttgtatttgagtccaggagaacaatgctgtgcccaggatatgtgatccttacttagcttctcatgacaagtctaagcatcctggtcttttctttccattgctcttccagagtgaatgactgcaataatcaatttagaggttttcaggggctgtattgtggaaacacctgggccctggagcacagcagcctgtgattgccctgggattccttttaaggaatttttcttgtcccctagagcttagactaagcggaggtggcctctggaccacagttatcttttttcagtattaagtagccaagcatcctgcaagagagatcagcacaaagagctccttgatcctctgtatttattttctatgacttccgtagcaaatcatcacaatctaggtgcttaaaacaactgaaatatattctctgacagctctggaggctctacgtccaagttgaaagtgtgagcaggacggctctcccagcaaaggttctggggaagattcatctttgcctcttccagtgtctggtagcttagtgtcacatgacttgtagcagcatctctctaatccccacctgtcttcacatggctttctcttctgtctcttaaaaggatacttgttactggatttagaacccacccagataatacagaattttctcatttcaagacccttaattatgtctgcacagactccatttgcaaacaaggtcacattcacaggcactagggactagtcggcttgagcatatcttttggggggctgctgttgaaccccgtgctggctactcacttctaaatcctctgaggtctcgggagcttcgttgtccggtgtttctctccacattttctcgggaatctttaagtgccagatacttcagagctgggaatgctgctggtaagggatccgggatgctggcatccttgcattgtgggcatgaataaccctgacctacaaaaattatcaaaaacaaccaacacaccaagtgtagaagaaaagaagtctctctcgggagagagaactgcttctgaaaagaacggacacatgagtgctttgatgtctaaaatctcaaagaacctagaggccttggaagagaaaactttaaaaatagacatgtttttaagttctcaatgcttcaatcagaaccaggtttcacaaagcctgttggaagatgtcatcaaggacagctgacatttactgataacttgccatatgctaagaccctggcgtgtattggatatgcctagccacaaacgaggcaaccatgattgttaatatgcttctcttacaaatagggaaagtgaggctaagcaaactcggcctccttgtgcagagttccaaaactggtgtggttgagtccggtaggataaaccctagcagtgtgattctgctatctgtgtggaatcccatctgtcgccagcaagtgagcctccgctgttcagggtttcccggctacaaaaagtagaagggctgccttctgtcgggaaattgattgcttggtgatgagtccacagctcaaaattcatacttaacacttttaagtagttgagctgttttccaagcgaagtggtcgagtggggctgaagtacttacttgacgagtctggttcagaaaaggtcaggtcggaacccacccagagacaccggctctaggcagcgtgatccgaacaataatttgttctcgccaaagtgacatttttccaatttgagtccagcattgttcagaagcaaatgcagtcccctggggcgcctcccgcatagatctgcagcagatgacaaactaacaatatcatctaaataaaaaatccagcatgggtttagtaaattaatcctgacaagaataaattgaataatcttagggaaatggcgagagctctgattctgccagatcgctcttttctgtcgcttgcgtgggtcctcggtggcagattaagagcaaaaatctgcctttggtttattgatttcgttagttcgttgattaacacctgccacttctgtgtgggtaaatcataatcggatatggactcttcctggcaaacttaacatattttcactcaaggagagaaaggaaatgcttatttcacctggtcagaacgggcaaaagcagacagagagctgcttttcctcacctcgtttctcagtggtattttctaggtttaaaagtaatctgtgattttcatcactcccatattgagttaatctcccgtttctgtttaggttgcttagcagacaaattcaaggagagtttttagtaagagtgaggggtgtttttcctgactcagtgtccgaagtcaagcagagacttcagccattaatttaggagacagggtgagaaaaggaagataccgcgtgtacacatgatcccacgtcctaggactgggccttacaggtcgtctgggaaccttgtcttagtcagcctgggctaccctaacaaactgccatagactggatagcttctgaacagaacatttactttgtcatagttcttgtgtctggatattcaagatcaaggtgccagcagtgtcaggttctgatgagcaccctcttcctggcttgtagtcagtcattctcactgggtcctcatttggacattcctgggcttacgctaccagagagagagagagagagaaaatgagtgagctctctggtgtctcttcttaaaaggatactaattctttctttattttattttatttttgagatggaatcttggtctgttgcccaggctctagtgcagtgacgtgatctcagggctcgctgcaacttccgcctcctgggttgaaatgattctcctgcctcagcctccaagtagctgggattatagatgcccaccaccatgcctggctaatttttctattatattgaaatccaatggggtttcaccttgttggccacgttggtcttgagcccctgccctcaagtgatatacctgccttagactcccaaagtgatgggattataggcgtgagccaccacacccagccaagggcagtcattcttaggacctcatttaaccttaatcacttccttagagttcccatctccaaatacagccacactgagggttagagctatgacatatgaattttaggggggacacatacattcagtccatcatactacgtgttaaaaatgttgattctgattcgatgtatctgggatgaggtgtgatgtgttgcatttttttttaaagatgggatcttgctctgtcactaggttggaatgcagtggtacaatcttagctcactgtagccttgactgcctagggataagtgatccccttctctttgttttgaaacagagtcttgttctttgttgcccagtctggagtgtagtggtgcaatctcggcttactgcaacatcagtctacagggtttaagtgattctcgtgcgtcagcctctctagtagctggaattacacgtgtgtgccaccatgcccagctaatttttgtatttttagtagagacaggggtttcattttcttgcccagacaggtctcaaactcctggcctcaagtgatccacctgccttggcctcccaaagtgctgggattacaggcatgagccactgcacccggcttcaagtgatccttccatttcagcttcccaagaagctgggaccacaggtgcataccaccccacctagctaatttttttcttctttattattattttttttgtagagacactgtctccctaaggtttccaggctggtcttcaactcctggactcaaacgatcctctggactcggcctcccaaagtgctgggattataggcatgatgcattttaactggctcccaggggcatcgtacttgctggggttgcagactccacgttgactaggaagttcctcatactccccttatgtgcggatgagggaaatttgctgaaggaccgcatggttattaaatagtaacaccctgctttaagagtctagtgccgtgagtctaatgccaggagtctaatgccagaactggaattacccgcagccctgtcctcccacccttcagccttcagtccactgccacatcccctggagggcttggtagcatgcatcgacgggccctcaccctttgaattttggattcagtaactgagggctcttccgtgcaaacctcatatttttcacttcaggagagaaaggaaatgcatcacctggtcagaacaggcagaagcagacagagagctgctttttctcacctcatttctcaatggcattttctacagaaaatacagcctgagaatctgggtatttttctttgcttatttatgtaaactgacaaaagttatatatatttatcatgtacaacatgatgtttggaatgtgtgtacattgtggaatggctaaatagagccaatatcatatacattacctcacaacgtcatttttttgtggttagaacacataacatctactttcttagcaattttcaagattacaacatgttgtgaactgtagtcaccatgttgtataatattttaacttattcctcctgtctcactgaaattttatgtctttaggcccagatctccccagcaaaccccctggtagtgagggtagtccctgccagcccttggtaaccaccattgtactttttagtatattttttgtatttgtttcatgcagtatttgtctttctgtaactagctcattcaacttaacacagtgttctccaggttcatccatgtcatcacagtgacaggctttccttctttattaaggctgaaatggtattctgttgtgtatatataccacatttgctttatgtggttcttccttgatggacacttagttttttgctttttgttttatttcagtaggtttctggggaacaggtggtgtttgattacatgaacaagttcttcagtggtggtttctgagattttaatgcacccatcacccaagcagtgtacaccgtacccaacgtgtaatcttttatccctcaccactccccgacactttcccctgagtccgcaaagtccactgtaccattcttatgcctttgcttcctcatcgcttagctcccacttatgaatgagaacatgcaatgtttcgttttccattcgtgacttgtttcacttagaataatggtctccagttccatccaggttgctgtgaatgccattatttcattcatttttatggctcagtagtattccattatatatgttggggaagtattttattacatatgtatatataagatgtagtattccattttatatatgtaagtatatgcatgtatattgggtaagttttctgttatatatgtatagtatattatatattgtattcatctatgtatagtattccaatataccacactttcttttatctacttgtggattggtgggcctttgggctggttccatatttttgccactgtgaattgtgctgctataaaagtggggtattcagtttgattccctatcttggctattgtgaataatgctgcagtgaagaaggaagtgcagagatctctttgacatacggatttcatttcctttgagtgaatatgcagtagtcggattgctggatcatacagtagatctgtttttaattttttgagaagcctccacaccgttttttgtaataactgtaagaatatgcctttttaacagcagctgatgctgctggttggagagtctcactttgagaagcacatgtaccttgcttctccaggtttttttgtttggttgcttggttttatttttatttatttttttctttttttgctgtgaataaccccttcttcccatagcaaggaaaagaatgaaacctgtggataaattatgtggactgaccaaaccaccttgaggaaaataaaattacctggaggaaagggaaagcacctgatgagggatcacttctggttacagatttaagctccctcattgtgtgattcagtatgagttacctaatggctaatcacaattatcatgccacagagtaactaaggaatacccactttgtcgaatgttggtaatttagagacagtacgaaaaacaccaagcacagttcctggcacgaaagaggtatttaatcattgctcaccggttcagtcccacttgactgataggaaaacagtctgttctacataaaacaagatatttgctatacgagtcttcaccttatgatattgtctctttttgttccactctggattcaaagggacctagaatttgctgtgtttactaataaatcaccagcttctcatattaacctttcctaatgatgcatccgcagagaaaaccccactgcctcttggtgagaaaatcaacatttctgtagacttaaccacaatggagtccctaatgttttttggttgtttaattgattggttggttgttttttggaaacagagtctcacttcgttgcccaggctgaagtgcaatggcatgatcccggcttactgcatcctccgccttcccggttcaagtgattctcttgtctcagcctcctgagtagctgggattacaggcgtgcaccaacaagcccagctaattctgtatgtttagtggagatggagtttcaccatattagccaggctgatctcaaacacctgacctcaggtgatccacccgcctcagtctcccagagtgctgggattgcaggcgtgagccaccacacccggcctggaacccctaatgtttgtaactccctacacaaccctgcacatccatgccctccctgcctccatggagagcatggccaggctacagaccgtgcaacggccccaggtcgccatctttctctcccaagctgtatcctttctttaaagacgtcccattgattttatctggcctctgactacttctctccccttcccctgctacacccttatccatccaccatcatgtcacacctggactcctgtggtagcccccaaatttttctccctacttaaatttgtaacccctgactgccggttctgttaaaatagaagtcagatcatgcctgtcctctcttcattatgcctgagtgaaacccacaagtgcccatgaggatgtggacagattggaacacttgtgcactgttagtggggatgtaaaatggtgcacctgctgtggaaaacggtagggtggttcctcaaaaaatgaaacattgaattaccatagggtttggcaatctcacttctgggcatacgcacaaaagacttgaaagcagggagttgaatagatacgtacacacccgtgttcatagcagcatcattcacaatagccgaaaggtggaaacagcccaaatatctatccacagatggcgcttatgaatggataaaccaaatgtggtctctccatacaatgcaatgttattcatccttaataagaatgaaattctaacacatgctaccacatggatgaaccttgaagacattatgctaagtgaaataagccaggcacagaaggacaaatgttgtatgattccacttaagcaagtgttaagtcctcaattgtataactgtaaaattcatatactgaagtcgtaacttccaatgtgattgtgttttggagattagtcctttagggaggtaattcaggttaagtgatgtcataagggtggggtcttaatccaataggattggtggccttaaaagaaagatggccacaccttacggtggctcacacctgtaatcccagcactttgggagggcgaggcgggcagatcactaggtcaagagatcgagagcatcctggccaatatggtgaaatcccatctctactaaaaatacaaaattagttgggggttgtggtgcatgtcggtagtcccagctactcgggaggctgaggcagaagaatcacttgaacctgggaggtggaggttgcagtgagccaagatctcgccactgcactccagtctggcgacagagctagactccatctcaggaaagaaaaaaaaaagccatgggtctgtctccctttctctctctctcagaaagtatagagcagcagctatgtgaggcaccatgagaaggaggcatctacaagccaggaagagggacctcaccaggaaccctgagagagccttgaccttgaacttccacctgtagaactctaagaaaataaacttcagtcgttgaagtcacctagtctgtaatattttttatggcattcctagccgactcatacaatgagaggagtctagagtagcaaaatccacagagacagaaagcagaaggtggttttcaggggctctgggaggggaagtgaagagttattgtttaatgggtacaggtggaaaaatgaaaaaattctggagatggagggtggtgatggttgcacaacagtttgtatgggtaatgccccagaactgtgcacctaccatggtaaaattgttaatgatattgtattttatcacaataaggtaataaaactctgagtggtttctcactgatctcaaaataaagtaaacatctccctgtgatctcattcccctttattttcctctcttacttccctctaaccacagtggcctccttcctcttgcttggctctttccagtgcatttcccccttggggctttgaacttgctcttcgtttgcctgggatgttctcttccccagtgggctacttggctcatccccctaacttccttcaagccttttctcaattgccactttttcaaaaaaatcaacatcaacatcgtattcccctaccctcagcatttcccacccccttctccttggtttatttttcttcatagtacatattctttctggaataccattaagtgatatgcatggtttaatgcttgtcttgtccagaagaatgtaagcatcaccagggcgggcctgccatgtgtcttctacattgttgagtcctccatgcctagtgcaaggtctagcagccaagagttgctaaagaaatatcttccatttgaataagttaatgccactattgcttgtgggactgtgtctgtcattttgtctaattaatgagttccctgagggtaggaattatgtttgtttcaccttttcgtaccaggacaacaagaaaatagcagaaaatcataggtgtgcaataaatatgaatgagtggatgagtggaatggtagatggatgggtggatggatggatgaatggatggatggatgaatgggtgggtggagggatgaatggagggtagatgaaggaaggaaagatggatgaatagatgagtggatagaggatggatagatggatggatgggtgggtagatgaatgggtggatggatggataggtgggtggatggatggatgagtagacggatgaatgggagaaggatgcaggatagatggatgattggatagatggggatggctgggtggatagctggatggatgaatggataaaaagatgaatttgggtggatgggcgagtgtgtagatgattgatggatagagggtggatgaaggatggatggttggacggatggatggatggatggatggatggatggatggatagaggaagggtgggtgggtcaatgaatggatagatgggtggatggataggggaaggatgcaggatgaatggatgattagatcaatgggcatggctgtttgggtggatggatggatgggtagaggaccaatgaatgaatggagaggagatgaatggatggatggttggatggttggaaggataaaaaatagatcctgataatttgtgttgaagtgagacatatctgactatcctaaattttgaatgggagagatattaaaggcagtctctgctgatgtgaacaattgtatggagggcagattattttatgagctatcagttcctctttgctgtgacctctgatccatagcctttgcctacattccacatctgcatgtaataaaacttacttatgagatacatatgtctctaatgcaaacaccgcagtatgtacctttaaaaagcactataaagagcaatgactcgagaaagaactattaggagcatgagctctttattattttaaagggcatttcaacaacaccactgaatgttctctgaccataagtctgactcctgttctttctctcactttcctttcttttcttctcttctcaggatatcaaagcagactgcaatacctgcgtggaaatagaagacagaaaggtgagtcaatatttttcatttttagggttgcaaacaaaacaagaactctgtgaattgaacccaggtgtttaaggcatgcccctctcgatgatggtttttaggtgattcacggtctatgacatatttaaagacaatcagacttaaaaatgcttgtcattttactcctttacaatctgtgttacttctgatggcttcatgaggagtgcatattgtaattttttacaaaaaatgtggtgctgatttctgtttcagtcatacccttcttttcaggaaaatactttaacacttgtcacattgaacttgaatattgatgttgacgttcattgtgtgtatcatatgtataattaattatattattacttacattatagaatatataatattaggcttcccagggtgtgtccctatatatctgactcatacacttgaaaaagagctcacggccaggtgtggtggctcatgcctataatcccaacactttgggaggcagaggtgggtggatcatctgaggtcaggagttagagaccaacctggccaacatggggaaaccccgtatctactaaaaatagaaaaattagccgggtgtggtggcacatgcctgtaatcccagctacttgggaggctgaggcaggagaatcacttgatccttggaggtggagactgcagtgagccaaaattgcaccagcgcactccagcctgagtgacaaaataagcctccgtttcaaaaaaaaaaaaaaaaaaaaaaaaaaaaaagagctcgcgctcaatttccatcacaacacatcaacacattcatatgagcaacagcgtcctatctgagattaagggggtagggggcaatgccattttctacatatttagagtcccctcacccatttatcttctttgctacacttaatgtgaatcccctcaggaaaagcaaccgttagacaattgtttgttaatattttcacagtctctttttattgacaagagttcacagacatttctgcagcaaagcacatccaagaagatcagattttaccctgtgtatgccttggatccaaagaggtcaaataagcaagttaagagtacatacctcctggctacttttgacatcgttccacaagtttgaaagatgtttctcctttcaagtgtaccattattgtcaaatgggttattatttcaagcagaggttttcagctctgattgtatcatgactggggcatgtctgctgattaataaggtggtggaggacttctcaaaacaaaaatttgcttttaaataaaaagcagttgccacacattattttagggagtgttaatctcctcacattgggaagaataatgatacagtaagttcaattcaatctgcgtgatcccagcttgcagttttgtgttgctctagtttgctggcaaaggaatttcaattcatgtttgcattcaccatgtgtttgcatgctggtatatgcatgtgtgcatttagtgagttggacagatggaattgctgcttaggtgaagcgtgtgtccaaagtcttctaccaatgttctgcccagccgaatcattccgctcatgtcagagtgtttagaaagcatgttccccaacctgcttccaaaggtcattggcatttctcttggacttttatggaattcatcaacatgttttgtccggtatcttttttaaaaatttaattgccaatagtgcttgaaagataacataggaactgatgctgttagaacaacctgagctccatcacgcacaaggtaaataagcaggcagggtaagctctgggcaaggagagtcacccaagctccactccacctatgtgaactgcctttggttaagacatcatgatgatggcaactgccctggtttctggctactctgtgatgcatcttggtgggaaaaagtcattaatggtcatactgtgcatatgtgatttcagctcttctcaagaaaggggaaaatagacacacacacacacacacacacacacacacacttctagttttttcataaattgttggattgagtcaataatgtcaaatgaagccttgtttctgatgagttttcccatttttttctaaacttgacctcatatgactgatagataaatttctaaacaatttgttgcagttaattggtgatgcatcttagtgataagaaaaaataatgcccagttaaaattctcagtgtcttactctctaaggactttttttaaaaaagagtcttttaaacaaggtaactcctctcctctcctctcctcccctcaactctcctctcctcccctctcctctcctcccctctcctcccctttcctctcctcccctttcctctcctctcctcccctttcctctcctctcctcccctttcctctcctctcctcccctttcctctcctgtcctcccctttcctctcctctcctcccctttcctctcctctcctcccctttcctctcctcccctttactctcctctcctcccctctcctctcctctcctctcctcttctctcctcttctctcctcttttcctccttccctttttctctcctcctttccttcccactttctcgtcttccttcctccctccttccttccttctttttccttccttcaaattcccagtaatacagtgaatcttatactcacgctatagtttctctgtttctaacaattgttaagaagagattgggagtgaggttttaggagcttgctttatatatgggagacatttctcttaattgaacagtcaagaagcaaacgctaatgatccctgagggacggcgtgcccctcaccccagcagaacagctccatccccctccctctctgcttggtgatatggtgtgaggccacacagggagccattggctgtggcagccagagtgattgccgtcaggttctgggagtgcactctggtgcctctgccacactgatgggttgtttaggaaatttcaccactggagtgatgacagttgctcacgcacgtgtgtgtgtgcatgtccctctccatttaacccaaatgcttctggcaaaatcagtaatttgataaagtggaattgaagtgacaagagatggcagaggtgccaaaataataagtaaacctgtctctgaagcggcagcctcttggcctatgtggatttttacgactgttgagagctctgaaagagaactggtggtgctttctttaaagctctttttattttattttattttattttactttagttaagggagcttcacagaacccctataggatgtgatggcttctcaagaatcactttattttttattattttttatttttctttcacctcccctggctttctgtctacttcgtttccagatattccacatatatggatatatttgtgtacctcgatttatagctatgtatattgttgaatatcttcttgatagaagaattttagaaaagacaaaaccttaggttttccatggagtcctacggggcctctccaaattgtgcctcattcccattctcttcctttcaatggggccgattatcttgagatgaatgattttcccactgaatcttagaccacatatcatgatagaagataaactgtgaatttcaacagtggaagagagccttcatttttttttttttttaacagtctccctctgtctcaaatctggattgcagtggtgtgatcgtgatctcagctcattgcaacctccgcctcccgggttcaagcgattctcctgcctcagcctcctgcctggctaatttttgtattcttagtagaggtggggttttaccatgttggccaggatgatcttgaactcctgacctcgtgatccgcctgcttcagcctcccaaagtgctgggattacaggcatgagccaccacacccggccgagagccctcatcttgttgtagagcaataaaatcattcttctttatctgcgcacagtctgggctcgatctgagactcttcatagaataaaagaatttttatcctctcctgtttttctatttttctttatcccagaagcctattttctctcaggctgacaggaaactaattgccatttggaaaaccttgcctggctgtttatggggaaattcataatgtgtattggagtgtggctttatgtttttctttcgcttccaagcccgccaattagcagagcccctatgaatgtacctgcttggatggttcctggccattgcttaaactctctcagagggtgtcctagggagatcctaagggatggtggagtttttcaccctttaataggaagcaggagcacaggttttttgtttttttgttttttggtttttttgttttttttgtttttttttttcctcctgcaggtgaacgttgtggagctaatgcagatttagcaaaggtgacgggaggtaacccatcacttggagtggctgtatggcctcacaaaacccgatgcgtttgacatttacagtacctgtgtttctgctggggcactgaagcatttaaattcatttttatttgtggtgtaaaatccacctgaatttcaatactattataaagactgagattcaggtgatgagaggagaggctgatggatcagtcagggggagaatctgtcaagaggagacgagagcccattttataaacacagacagggcttcctcttctcacttatcgcctggcctggtgcagctaaacagtttcagatctgctataaaattgcatgaaaggagtttgagtggttttccaagttatggcgactttcagattgggtccaattgaaggtgcgattgggagatagctttcgtgctgtggttaacactgagagttctgaactcatctttttacaatacttcttccagatcaggtatcttaagtaccgccgaatacttaaaacagttgtggtgtggaagtaccatcattttccctgttttacaggtaaaataaaggaagctcaggcacatttaagtgacttgcctgagatcactcaagcatgagaccaggatttaagctcagagattcttactccagagtctgtcctcttagtttcaatactaccctgcttgcggttttcaatatggggcaggctttcagctcccacattgcagctctagctggttcacagtgaggattcttcacagtgtttacaagcctgcccttccgggaagtagttggcacccaacagtggggtggtcagatgtcttctggctttgagggtgagggacagtagcactggaactggagtgctgacctcagtttccaaagacctgattcggttcctaggtttggcaatttcagcagagtagatacacgggttagaaattattgcttaaagagtattagggaggctgggcactgtggctcatgcctgtaatcccagcacttttggagggtgaggcggcctccaagatcaggagttcgagaccaccatggccaacatagtgaaacatcatctctaccacaaatacaaaaatttcctgggtgtggtggcacacgcctgtagtcacagctacttgggaagctgaggtggagaattgcttgaacctgggaggcagaggttgcagtgagctgagatctcgccattgcccttcagcctgggcaataagagtgagacttcatcttaaaaaaaaaaaaaaaaagcaagaaattcttgcttaaagagtattacggaaaatagctaatgcatgctgggcttaataccttggtgatggattgataggtgcagccaaccactatgacacacgattacttatataacaaacctgcacatcccgcacatgtaccccagaactaaaaataaacataaaaaagtaattcttgcataggtaatggttagtagctcagacaaattaagtcacttgcccaggattattcaggacgtatcatgaggccacgatttgagctcagagattcttactccagagtctgtacatagcctttggagcttgaaatgtctgggtttcaatcccagccctcccaaatagcaactctgtgaccttgagaagctttcttaccctgtatatatcttcatctgcttatctttaaattgggagtgatacaatctgcttgaaatattggcttgagaaattcataatactgcaaatcattttatataatacctggcacaaaataagaactggattaactgtagctgcggttatttttatttttgctggtatccacacctacaggcctaccatgtcatttataattacatttattttatcaaatgaggccctggaaagtgttaggggatctcaggggagtatgcaaccaatgggacctagtaggccttggaaatatttcacaaaggaagaggatccttggtgtaggtcaggaaatacaaatgcacctgcctgccaagtccaggtaggaaataatgaattaatgaagaggcagaggagtgattgtctttaacgtgaagtcctatgtactgcagcgacctggaaggtgataccttcatatcttgggagctgttattcagctaaatgtggccatgtggaatatagattcagtattgctgttttctaagccaatctgaattttcctgtaataccactgattttttacttactatgagcaatccaaatgaagcacacatgcagaaaagtttcaagagacttacaagacttgagtgttgaaagctaactctcagtgggttagaaagagctcccatgtgcctaattccaggctctgtcggtctatgaaaggccctcctggcagagggaacagaatggcgaggacaagacggtgtagagaacatggtatgtttatggcgaatgcaagtccagtgtgtgtgtctgagattggctaaaggagagactacagcagtgagtaggtagcaggttatggagggaatagtttatcaggccaatgcattagggttctgtgtcaatcctctgtccccacagaaggcaaatctttactgtatggggccagagttacacagcaccaagaaggtacttaaactagtatgaagaacccagccaaagtgaaagtcagcaggggaataagaactggggttggagcccagagaaagacccagagactggccctgggtgaatgcaggaagctgaacactttgattcgagcaagacgaagtcagccaggaccctgagaaatcacagggctgggttgccccttccttgtgatgtgtgacagaatgaacatgggaatgcaactgtctctttgaaatgttgatttagcggcgggatgcctggattatttggtagttcaacttctaattttttgaaggacctctatactgttgtgcataatggctataaggatatatgagaatatccattttaacatcatgggagttctacaatggaatattatttagccattgaaacgaagggaaatcctgccatgtgcaacaagatagatgaacctagaggacattaggtgaagtgaagtaagccacacacagaaaggcaaatactacatgagctcacttttacctggaatctaagaaagtgaaactcaaagaagcagagagtaggatggtggttgccgagggctgggggcggggtgaaaaaaaagggaggatcttggtcaaaggatacaaaccctcatcatcagattaagttatagataactaatgtacagcacagtgatgagagtttaattaatgtgttttagacttgaaatgcggtaagagagtagatctcaactgttctcacacacacacaagtctgtgagatgatggatatgttaattagcttggtagtagtaatcatttcatgatatacacatgtatcaaaaggtcacattgtatctgttaaatatatgcaatttttgtttttcagttttatctcaatacagttagggagaaaaagagagatgtggaatagaagaggaacacattttcctgcaggccggtattgtacaagtgttgaaacacttagattagatttcaggtggcaaatgaggtaccttcaggcagttcatggatatggtatcaaatcacgtagtagggaagttatttccttgtcaactatttctcagaccttgagactacatcaaagacataatttggtggttggttaaaaaaaaaagaaaaaaaacctaaaagactcaaacatttgatcatctacctttttgaccaagagacccagagcccctgacaggcaattctggcatctggctataaccgaatgacagtgttttacttttgcattagagttactttctacatatgacaaaaaaaatactgttctttctgctctttctgtttacttcaacgagctatttcttttctttaaaacaaatactcccatagactcgtaaaacatttattgagaacagaaacaatttaaagaaaagcacatggatgtgtaaaaattgtgagtatggatcgcacataactgaagtgtaggaaacactgttttctactggtgggtttgcattcaggggagagtttcttgtttgcattttgtaagtttcaaactctccttgtgtgcaggagggaaccagaagtgggcagggatggatacaggagtacagggtggaaggcagactggaggatgggtctgaactagagccatgtaggagatggggaggaggaaggtttgcattttcaagagactggataagtcctatccacatgacttactgacaatggatgggtgtcatgaatgtctccacccaggaacttgtcacagacggctcagcttaagtatttgtatatagtttgctgccgtgaggaagaagaaaggagttgatcaacactgacaatggattgatctcctggtttagggcttatatgccagtgaggttgcatatgagcatgacatagccagcaggatttgtttctattagtgccagtctcttgcccctgggagtaggagtggactagatctgtgcacttctgatagcagaacaaagacatgggagaaggttcactccttcctggaagggcctctttctagaatggggagtattcatgaaggagtttcccttcaaagaccaaagcgaagatacttaaggcacataagggcagaggctgctgtgagcgcccatctggatgagactcacagagtcccctggggattggatttcttttctgtttccaatgtcctttgtttaaggccgttaggcatatacattaaaatggaagaagctccaaaattcctggaatctttggaaatgaaaattagagcatccctgagaaagggtatttaagtttgagtctgaagggagatggggtggagagcatcctgggccaggtgcagaggagggagtctggaggttgagcatggcatgactaaggaactgaatacacgtcagtgtagctggggctcaggcagcagtgggaaaagtggctagagataaagctcaaagcaggcaaaggctaatccacctgaaaccttttgaccaggaagagtattatgtcctttaatatagaatgaaatctgtgtcacatggactgtgatatcaccatgagaaatggtcaggtgtgtaaagacagtttctttgtcttatagagtctacttgctcatagatcatgtttatgtatgacctttcagacttctgtcagttcccttctggtccagccatctctagccaaggaatgggacaaagagatctaacaccagcaaagctttttgctgtgtcgcttggcttttctgttcattctgcattttacatcctatgcaaattccctaaaactgtcaatcatcttcagattagtaaccctcattcctcttgggcatggctctcattccaaactaatgcatagccactagccagcctgttgtttagggcaacacctcacccctggtcctactatctctggtcaaagaaatgtgcgcggtcatctagcgtcagcaaatcatcttgtatctacagatctgcctcagctcctttgctcagtaagaacttgtggatgggatcttggtaggatgtgatacatataccacaagtagatctcattgtgtcctttttctctgctgagaagcagggctgtgcgagagacagctgcgcatgtagcccaccaccagtgagattcgacatcatttttactgagactggggaccaggcaatagcagagattatgaatccagtgtctgaaattgcgtgttcagaacccacagataggcagggatggaagtcagttctggagatactcagttggtggagatgggttgctgccaagaaatcctcagcagttttgttcactcctcctaatttatttcaaaaggcaaggtagtacagttttgcagtcaaacggatctggagttgaatcccggttctgccccttcaccagctggcagaccttggaaaagtcacattcctgtctgtccacagctgcatcgtctataaaacagggacagacatcgtttgtaaatcatgcatcccatgcactgttcttgtgtgccgcattagtcagggcattttcaattgtcatagaaaatgaagtcagactagcttaaggagaaaaataagtgacagttatgagtaaagtgggactgtcttcagcatagctggatgctggtactttaatttcaccagatgctaaggacggcaaccaccagctgtattaactcccacctgtggagaaaaggcgcttctttttcagtggcttagtaaagttcctggatgtggcttaagaggtgtcacttagctataaagggcgatgtccctcttgtttgtcttccctcagccaccccagcagtgggatggggtccagctaaatgacttaaatggactaaaaaatgagggagggggctgggcacggtggctcacgcctataatgccagccctttgggaggcccaggtgggtggattacctgaggtcaagagttggagaccagccaggacaacatggtgaaaccccatcgctgctaaaaataaaaaatataaaaaaatattagccaggcatagtgacaggcacctgtaatcgcagctacttgggaggctgaggtaggagaatcacttaaacctgggaggcggtgattgcagtgagctgagattgtgccatcacattccagtctgggtaacaagagtgaaactccatctccaaaaaaaaaaaaagaagaaggagggagtgtcacctaatgaaaccttgactgatattttttttccagaaaggaaaataaataataataataatagcaactaccttgcattgaggatttactacatgccatagaccattttttagtactttatgcatattctattattgaatccttagaaagatcctttaagacagatacaatatttatccccatgttacagatgagaaaaatgagggaaagaggtgatatggtttgaccacgtccccacccaaatctcatcttgaattggagctcccataattcccacatgttgtgagagggacctggtaggaggtaattgaatcatgggtatggtttcccccaccctgttctcatggtagtgaataagtctcccgagatctgatggttttataagaggaaacccctttcgcttgtttttcattctttctctgccaccatataaaacgtgccttttgcctcccatcatggttatgagacctgccagccacatggaactgtgagtctattaaacctttctttctttataaattatccagtctcaggtacatctgtatcagcagcgtgaaaacagactaatacaggaggagttgaagaatgtgactgaggccgggcacagtggctcatgcctataatcccagcactttgggaggcttaggcgggcggatcacctgaggtcaggagtttgaaaccagcctggccaacatgatgaaacccttgtctctaccacaagtacaaaatgtatccaggtgtggtggtgggcacctataatcctagccatgctattcgggaagctgagttaggagaatcacttgaacctggaaggcagaggttacagtcagctgagatcacaccactgcactccagcctgggtgacagagtaagactctgtctccaaaaaaaaaaaaaaaaaacaaatcatgtcactgaggtcacccaggtggtaactgtggaggtgggattcaaacccaggaagtctttgtttgactcttaacctctaggctgtactgcctcttccaagcatgcttcacaggaagaagaaaatacgtcccttctgtgctcctcatgctcagggcctgacacacaggtaaacggtgacttacgagagttattgcaacaaaaccctccacataacaggaaaaaccttggccactgctaaatgtcatcctgtgatatatctctgcattgaatttcctcccaattactcagcctaaggtattatctcggggtcctcaatgagtctgctccacagaaccatcaaaatgctcacggttccaagcagtgcctcacttgccagcacagctgacagttatttttgtaggcaagggcttctgactctaggatgggtctctgcacctgccttttatatttgattcacaggttaactcttttactaaacgttgaaaatgagatgttagtcgtactttcctctttcatttatttttgggaaatttgagggtggtggtgggttgggggagagggaggcaggtaaaaagacgcagagcttctaaaatgaatgtggtgttgagttaaattagcctctgatgggccggaaacctaaacgacagatgatgagaagctgctgggcaccctcagcagtgccatggacacagtggtaacccagagagtgtaatgaaaagcactgaggtagatcgggctattggtctcatacaccttcagtcacccttgaagctggctttgggaagctcatctaaagaatgccaggtgtaatcgtgtggctaagagcttcagcttaggattctaaaaggcctggctttgaaccccagcttagtggcttcctggttatttaacctctcagatgctcaagctcttatataaaagggagaggaggagagaatattttctggggtcactatgggactcaatgagctcttacactgagggtacttatcatcttggctaggcacaggatgcaccttgaataactgcaagctggctgggcacggtggctcatgcctggaatcctagcgctttttggacacaagtgggaggattacttgagctcgggagtttgagatgagcctaggcaacatataccctatttctgcaaaactgaagaaaaaaatatagccacatagttaggcatgatggtgcgtgcctgtagtcccagctactcaaatggcttaaggagaaggatctctggagcccaggagttcgaggctgcagtgacctatagtcgtaccaccacactccagcctgggtgacagagcaagaccctatctttaaaaaactaaagaaaaaaaaaataagtacaagctgcctgattattacacttaaatctgctttcgtcctactcttttttaaatctttgactctgtttcttagattcctagtgagatcagagagtatacatctaggacaagttaagataatagcaaagtaaattacaaagcttaaactggataccaaaccctcaattacctgtctagagttttgtgtatcctgtagctacttctcaatctgactgaaagagtatagagttgagagcataagtaaaggtgcagaccagggattggaaacagattgaatctctggtgtcaagtcatattgattgtggcggcacagaacaccttgttgatgaggagtctgagattgtggcatgtgggttctcccagaaagagtgcatgattgattagtgatgcctgccaagggtggaggagtgagagccacagggcacctgccaggtatagtttagttgtttctgtcacagaatctggcatctgaggagtaatacaaagccacgtgttgtgtgtttcagcccaaagatgcttctgttcttaggggcatgcctgttttccttatgttttggatttgcagcttaacaaggcactggtattttcatggatagtgcatggcttaaagataatttagcaaataagagctttatatcaggcatgggtagctagcctttcctaggtgctcgagaagccttctctgttgattacattatggtagcaattcacatgatgtcatcctcatataactagggttatgttttgatgccttaattttaaaagtgtgatttgtctatgatgatatttgtcatctctttgaaattttgtattaattggggctgaaatgcttacattttaatatcattatttatagctattattttcatgtgccacttattttacttaaaagaagcaagtctattttgtgtaatttttagcaaacttctttctttaaactctgaattaaaatgcatttaggaaatgcttaatcaagcacagagctatttttcaaagattgttctgtcatctcttctaaaaagatggcagtggcttttttgtgatgagtggagtgaacgttaattaatttttctttctcttcagttggtgggttttattatcccacttcttgatgtgtgattgggtgacttcacactttagatagaaagcatgccctatccaaatgtgatttatgttttcccagcacttttgcatggttcagctgaaattttcttcgtgttgatcaaggtcagaaaacccagggattatgccatccatctcagcaagtaggttgctggaaaaatttgtgatggaacgtgatgcaataacaacagaattcaagggtggggtgggaaaccatgcccgtgtgtgtgcgtttgtctatcacatgaacacactcacccaattcacttcttatattgtgcttctttttatcaagttacaaggctttttgggcaattctgggttaggatttatttttgcataaagccataaaaactgtgtgatctttttactgtggccatcttaaactaacagctatcagaatttgcagatcaaccagaggtttttcatattttctttgtttttttccagagtgattgcagtatgattgacaagtaaaaattatatgtttaagatatacagcttgacgttttgattttcatatacattatgaaaaagtcgttagaatcaagtgaattaacacatctatcacctcatatattgctattttttcttttgtttcttttcttttgcgtgtgtgtttgagtgtggtgagaacacttaagatctaccctcttagcaaattttgtatttccttttcaactgaaaggttttctgggtgctttggaggacagaaccttcagaatagaaaaggtcctaagcttaaggacttctagcttttggttaagggagcacagtagaaaagcaaatgctcaccatgagccaggcaggcagatctgatggagccagggaggtagacggcacttatcatcctaagtaaccgacccatggtatatggagaatccagtcaaaggagtaacttacaaacttcaagtccacctgtcaaaatagcaccctaacttacagtaaggaaaatctatctctgtctgtctatctatctatctgtctatctctatatattgagacagggccttgctctagtgtccacgttggagtgcagtggtatgatcatggctcactgcaacctcaccctcctgggcacaagtagttatatagtaccaagtgggcatgttgtacttactcagtgtgatcctcctacatcagcttcccaagtagctggaaccacaggagtgcaccgttatgcctggctatgtttttttttttaatttttgtagagacggggttttccctatgttgtccaggctggcttccaagtccggagctcaagcagtccttccatcttggtctcccaaaatgctgggattacaggggtgagccactgctcccagacaaacatatgtatttttaatttgatctattcagattgagttttcatgttgattgaattcaccaattcataagttgacaaatcttaattttgccccatgactggaatgttttcataaagaaatcataaaattagaagagctaaggatataacagaaaacatacccccaaagaaagcataagtagacttaaacacccggtaatacctttccttgatagtggtatgaaaatgcaaattaaaaccatataatataccaatctctatctactaaaattagccaggttaacatgaaataagaatactaccttttcccatattggtgatgttgctataaaactggtttccttatggccgggcacggtggttcacgcctgtaatcccagcactctgggaggccgagctgggtggatcacaaggtcaggagatcgagaccatcctagctaacacggtgaaaccctgtctctactaaaaatgcaaaaaaaaattagccgggcatggtggcgggagcctgtagtcccagctacttgggaggctgaggcaggagagaggcgtgaacccaggaggcggagcttgcagcgagccgagatcgtgccactgcactccagcctgggtgacagagcgagactccatctcaaaaaaacaaaaaactggtttccttatttacttggtatgttgcaatttggtagaaatcatttaaaaaccagagtactcatacgtatgaacaaccagataattatttcttttgacccaatcttactcattatttcttattattccagtcgaatggaaacaaaaggacacctggactgagccaccattgttattttacttgcaatgtcaaaatattggcaacaacctaaatgcttaatcttaaggtaatggcttcttatgctcagcacagaacatgatagagtattatgcggctattaaaaatgatgaatacacttgtgtcagaggtccatggaatagtaattgatataatgtttaataaaaacacatcttataagatattttgaccatgtctaaaatttgcatggaaaagagaaatattcatgttcatattcaaacatcattttattaatttgatatttgaacattagaaagtaagacataatagaagaatagggaagtctgttgggatgcatctaggaaggaatttaggactgagtttgggcaagttccttagtctttctgcatctcagattcctcttctgaacccaatttgtagttttctatccctcacctgctccccaccctttccgcctgagtccccaaagtccgttctatcattcttacgcctttgcatcctcatagcttagctcccacttaggagtgaggacatacgatgtttggttttccatttctgagttacttcaattagaataacagtttccagtcccatccaggttgctgtgaatgccattaattcattcctttttatgacggagtagtattccatcgaatcagcgtatcccagtaattataagagttcatgaaatttttgtgtgccattttacattcacactgccttttcacacgccaagttgcctttaaaaactgttgcgactactaagtagataggatgataatgcgaaataacaatatcgaacagctgattttaaatggcttggtcatatgttaacttatgcactgtaccaaatgtttctgacattatttggaataggtgaacccatccgatagttgttaatcacattcggtttcaaagaccgtaggtccatctcacctaattatactggtattggaggctaaggtaacattagctagaaatagatacttatcttttatttagtttctatttatgagcttttggaaatacaaaggtcattgaaatataatcatttcttataatccaccaccataacgcttagagtccattggagaaatatacatccaatataaatatacatccaatataaaataaccatacaaatattgtggtggggaagggtggcagggagggaggagagtgagagagagaagagggagaaagagagagagaaggagagagagaaaaggaaggacggatggatggaaggaaggaaaaagaaaagaaagagaaaagaaaggaaaggaaggaaagaaggaaagaaaaaagaaaaagggagggaggaagaaaggaaggaagatgggagaaaaaagaaaagaaagaacaggagaaagaaaagaaaagaaaagaaagagaagaaattctgtttatgtgacagaatcttaaacaagcatataagactactgacttcaggtacacatggatccaggtcctgaaatgattccataggaaacctccacccaccatgattccgcttctgcttttctgcttttcttgggtttggcttgccttgtgaagcagtgaggcagacatcagcagtgttagtcataccttctaccaattcacagttctggtagaaagatcgtttctcttcccaagtaatcctaacttaagcccatttcttaggtggacctatctctgatgttatgggtcacttgccccctttcccaagagacccattgactaaactgaatccccctagaccccaggcaagggcgtgtgggatgttgatcaacctggtctgaattgtaccccagtccctgaagtgctgatatgaagccagtgcaatgctaacaatatggaaccacaacaggggaaagacagctccctgaagaaaaaccacagtgcttcttaccagagttggaatagagattggtcacgtaaatgcaacacttgcttatagcagacagaggtgcaatttccaggtgatcagtgatgtctacacttcccaggctcatcattttatggtctccatgctccttccagagtagtcttcatcccatctgtgtcttctctatccactctctgatcccaaaggtccctcatatccctgtacgaagttgcaagtaccagtcattcaaaaatgtattgaggccaggcgtggtggctcatgcctgtaatcccagcactttgggaggcctaggtgggtggatcacctgaggtcaggagtttgagaccagcctggtcaacatggcaaaaccgcatctctactaaaaatacaaaaattagtcgggcctggtggtgcatgcctgtaatcccagctactggggaagttgaggtaggagaatcacctgaacccaggaggtggaggttgcagtgagtggaggttgtagtgagcctacattgcgccactgcactcaagcctgggagacagagcgagactccatgtcaaaaaaatatatagatatgtattgaacacaaagtaatgaaatatggggctgacttgccggggtggaggaccagcttcatgatgggttctgtgacccatgtgcctggcagagagaagaggctatggacaaaggcaaggacagaaatgtatcatctgtcatggagataagtcgcatattcctactcacaaaaaggcaggtgtacatttctggacagagaatgatagccaagacagtgctagagagaaaagtagttacagatattaagagaagaagcaaacacttgttggaggaagtgccatattgggaggatcctgaaagactggccaggtggaatggatctgcacacctccagaacaaaggaaggagactctaggaagggagaaacagtgagggaggaattacttcttttagagacatgttaagagaatcctattttaggattaccctaggaaataagtaggagattcagcactctcttggttctaatagaaacaccattcaaattggcttaagctaagattggtattaagtccttgttgtgggttgaatagagtcctccagaaaagatatgttgaagtcctagcttttcccacccccatacctgtgaatgtaaatttatttagagatagggtctttgcagatgttatcaagttaaaatgacgtcatcctggattggagcagtcgtaaaaccaatgactgggttctttatttttatttttttttcttttctttttttgagtcagagtctcactctgttgcccaggctggagtgcaatggtgcgatctcagctcacctcaacctccgcctcctgggttaaattgattctcctgccccagtctcctgagtagctgggattataggcacctgtcaccatgcccggctaatttttgtatttttagtagagacggggtttcgtcatgttgatcaggatggtgtcgaactcctgacctcaagtgatccacccacctcagcctcccaaagtgttggaattacaggcgtgagccaccgtgcccagcccgaatgggctcttataagatggagacctggagatgtacgaatgtagactcacggggaagaaaccatgtgttgatggaggcagagactggagagatgcacatacaagccaaggagcacgaggggtgctggccaccagcagaagctacaagaggcaaggaaggattctttcctagagtccccagagaaaacaagaccctattaggactttgatttcagacttctagcttccagaactgggagagaataaattactgttgtgttttttgtttgtttggtggttttttttgtttgtcttttgttttttgacacagtctcactgtgtcacccaggctggagtgcagtggcatgatcttggctcactgcaacctctgcctcccaggttcaagccattctcgtgcctcagcctcctcattagctgggactacaggtatgtgccaccacacccactaatttttgtatttttttgtagagatggggtttcaccatgttggccaggatggtctcgatctcttgacctcgtgatccgcccacctcggcctcccaaagtgctgggtttacaggcataagccactgcgcccggcccatttctgttgttttaagcaacccaggttgtggtgatttgttgcaccatccctagggaactaacatatttccatgtctgaaaatcgagggatatctggctttaggtatgcctaaatgtaggtgctcttgcaaatgtcatcagaagtgtatctgtcccaatttctcattttttttttcttggagttgactgcaattcaggtgggctcttcccaagcagagcaaactggcccagaagattatttcaagacttgcatttgacaaatttagtgacaaagccctgggcttggtcaggcttgcatcctgtgttcattgctgaaccaggccctgccacagtaggcatggtgtgttagtctgttttcacactgctgataaagatgtacctgagactgggtaatttgtaaagaaaaagagctttaatagactcacagttccatgtgactggggatgcctcacaatcatggcagaaggaaagcatgtgttacatggcggcaggcaagagagaatgagaaaacaagcgaaagggctttccctttatgaaaccatcagatcttgtgagatttactcactaccacaagaacagtatgggaaaaccactgctacgaatcaattatctcccaccaggcccctcccacaacaaatgggaataatgggagctacagttcacgatgagatttgggtgaggacccagtgaaaccatatcacatgggatgtggtatttgtccaggcctgagacccttgtgaatctctggaactttggacaagcgtcagctttacgtggacaccaagggcgatgggagaggagaggttctcaaaaggaaaagaggtcctcaaaaggtttaaaggaaaactgaagggaagtcaacataggggtttggggttgggggtgttattatcagaagtaggtagaaggatgctgcctaggggacacacacacacgcgcacacacacacacacacacacacacacacacacacacacttccctaggtcaactaggatcagataggtaggctggagaatagtagaggtgagtgttgtagttacggggagttcggaggaaggccttccatgatcagaaaggtgtgtggagaaagtggatagggaatagagtactatcctgccttccagtcaattttggggagtcatgagctgtttcgtttttacaatggcagcgcctgccccagttgggtcctagcccaaggtcaactctcaatagtaaataaaggtgccaggaaggcagtatagcaaccaagagaggaggcagaaaggtcctgaatggggagggccttgggaatgaaaactttgacttgatcattacacattctatgcatataatccacaaacatttacccctatcaatatgtaagctatttcgtattgataggaccagctcggaaaaaaggataccaggagcctttacagatgttattctcaacttactttctttttttttctttttgtttttcttttctttttttttttttttttttgagacaaagtctcactcttgtcccccaggctggagtgccatggtgcgatcaagggtcactgcaacctttgcctcccaggttgaagcatttctcctgcctcagcctccctagtagctgggattacaggcacccgccaccactcccagctaatttttgtatttttagtagagacggggtttcaccatgttggccatgctggttttgaacccttgacctcaggtgatctgcccacctcggcctcccaaagtgctgggattacaggcatgagccaccatgcccagccgttaactcaactttctatgcacagatccaaaagaccaaaagacttgaaaaagaataaaaggcacttttaagtactaaatgctttctacttgcaagactaactgctttacaagcatgattcatttaatctgcctatttaaaaaagtagatagatactttttttcagatgatgaaatagaattccaaaatattcaatgaaagtaccaagttcacataatgagtaagtggcaggactacaactagaatacaggttttccgtgctctagagaccatagataatttagctcctgttagaaggcacagaattaagggtggtcaacacatctgtcattccttaaggcccttttgtaacactgaactgatatatctccatagatacaaacacacatcaagatgtaaatatatgtgatatgtttctatggagactggaggcctattttattagtctaagatccatggacttattgcccctaaaaggctacctacatcaaaagatcctaaaaagaaagttttaaacatccagcctaaattaagaattccatatcaaaaacatcagggagctaggattaaataaaaattaagcccggaagcagagtaatgactcagcagttcattagagccttacattttcaatcaaagataaaatctcattaaaagtatatttttgattagggaacaagtttgggctgttccaaagttggacggctgtatccatagacatgtgagccatgaaatccttttttcctcttttgtaactttaaagatagtgagcgatttatcttctgacatcactatacaagttattaatatagaggaagactgaacaatggtggcagagctttttatgtatctaccagtgacttttaccccataaaattaaaaggcctattaatataggctcttccaattttaggagcaatttttgtttattactaaagtgattaatcagtaaggaaccataaagaacatctaacctagtaccgcctaatagaaatataatgtcaaacatatatgtaatgttacattttctagtagcaacattaaaaaagctgagaagaaacagctgaaattaattttcctcatataatctattcatcctatatagccaaagtattctcatcatctacttaaattaaaagttttgttttgttttgttgtgttgtgtttgagacggagtctcgctctgtcgcccaggctggagtgcagtggcacaatctcggttcactgcagcctctgcctccttgagttcaagcatttatccaacttcatcctctcaggtagctgggactgcaggcgtgtaccaccacacatggctaatttttgtgtttttagtagagatggggtttcatcatgttggccaggctggtttgaactcctgacctcaagtcatctacccaactcagcctcctaaagtgctgggattacaggcatgagccgctgcacctggccaaaagttatttatgatatataatatgtttaggtgtgtgtatctgtgtgcgtgtatgggtcctaaaccttcaaaatctagtgtgcattttacacttacaaaataaagagagtgaaaccaaagatttgagatttctctttagaggttttgtgataacacaagtgtttctattttgacagcggattgcatactagatttttcctttttgctttaccatatgtgggaaatgacacttctaagacacaagatacacagaacaaatgtagggaatcctttaagctctgtgtatctcagagtagatgctctgactgattaattggaagaagtgctaagataccactgacttgaagctttgaaagttaatcacttgccatgaatagctgataaggcttgtaacacggttcatccaggaggctgagtgaggctgggtagatgggtggtttatcgcattgtttccaagtgtagcatgaattccacccttcttacatgaagccatttggggtggcacatggatgtggcattcagtataattgaatcatacagtgagactctaatttctttctcaaatccatttcattctttcagatgtcaaagagatcgactctgcgtgttgctattatatctctaacacctctctaacccttgctaatctttttgaacagagagagagggcaagcaagctttcaacagacaaaatatgcagccagaatttcacaactgaggaacattgcagtgttccacccattcagtctgagtctccatctatttatggcatatcagactggttttcagttttgacgatgacatgaaatcgcgttttaaagtttactgacacgtaaaaaagtgagcttaaagaaaaataataagctaatcatggtaaaggtgactcaaggagaagataacaatgacgagcttgatatgtggatgttctgatgtttgggaaatgcttgtcttgctatattggtgatggaaaggggagacttctccatgcttgctgcagacatcattgcagtgcctcgtttcttggtctcactttcctttctttgacctgggaagtttccacaaatgatgcttcatggtcgcattctggatcacatcttacagagcaatggggaaacatgtacagtcatacccctctcttctaggaggtagcctcattatctttttatgctaagaacaaatagattggaaagggtctaacatttttttgagcatctcctttgctcaaaactttaaaacacctgtataaagcatagtctaaactaaccaccacaccatacaagagtacttgagtgagttctttgaggaggaaatggatgaggatgtggtatttgtgcatgtaacttcccttcctttctgttttcaagttcagtttgtccagtattaattcatcagagatgcagagaaaggctaaacaaacactgggaccttctacataaagccatagtttctacttgtttttttttttttttttttttttttttcatacttttctgagctttgcctaatggtctcatggagttctttaaagtagtgtttttatataatctgcctgacaggcaagacaggatggttgaaatttatactcccaaatatgacagagttcaacccagttctgctgtttcataacagtgtggtcttgaggaaatctgaagagattggcaacttggaacttcagttttctcatctgtaaaatggggtcatagaaggactaccacatagggttgtgtttgggaatgagaagagatagaatagcaatttcgtatggagctgcgcatatattcagtaagtggtcgaagtacaatttttactatgagtatgattcctgtctttgctttgcttttctctctctcttttttttttttttttttttatttgtcgcccaggctggagtgcagtggcgccatctcagctcactgcaagctccgcctcccgggttcacgccattctcctgcctcagcctcccgagtagctgggactacaggcacctgccaccacacctggctaatttttttgtatttttagtagagacgaggtttcaccatgttagccacgatggtctcgatctcctgacctcatgatccgcctgcctcggcctcccaaagtgctgggattacaggcgtaagccaccgcgtccggccctctttgctttttcttagacctcctagcagatgatttgacttgagttttattctaaaataacaataaagtttcaattttatactcttattttagttttccactatcaaagtttaccgcttagaggtaatatttaatgagactttaatcagacttctgcggttctgatttacatgtttgtgttttatctttgtaaggcggaaagatgctagatgggcacctaactttgcaaaccattttttaaataaatgttgcaatattaaaagcttcttggttaaaacatgaatgaagtacctttcactgtttcagctaccatggtgagcatagaattgaatcaatatttatacaaagattacaatataaatgcaaattgagctgcatgataattgggcctgagtaacttttaacatagttcgtagaaaacttcaaatttctgtactggtctcaaagtaagtagaaatctgtttaggctgggcatgatggctcacacccataatgccagtcctttgcaaggctgaggtgggtggatcatttgaggtcaggagttcgagaccatcctgggaaacatggtgagacccccatctctactaaaaatacaaaaattagccaggcatgatggcacgtgcctgtagtcccagttacttgggaggttgaggcaggagcatcacttaagcctggaaggcagaggcagaagttgcagtgagccaggatcacaccactgcactccagtttaggtgacagagcaagagcctgtctggaaaaaaaacaaaaaaatatattttgatcgcatcttggttaagtctttgctaccttggttaaaaagtttggtatcttggtagcaaatttttatcaattggtaatatttgcctggcaagctgtgtgaagaagagttcagaagtataaccagatttagcagaagtagttctgtgatcaattagtgatgttgtccttgtctccagaagaggtgtttttcatctccaaactttagtcagttgagaaaataaagtaacaatttgttgttaatttggcccgttagttaaagccgtaaacaaagaaataagcaataacatataatcacaattgcccccctccacaatggtcatttaaccagaaaaaaaaaaaaaaaatctttctccaatgagtaaaatgttcaaacttatctgacgatattgataataatataattaatagacataaccactctctgtaattcagttctcacgtctgtaatgtggagataatagctaccctttcttttcagccgggatactctaaagacaaagtgagctattttgagtgtcaatccagtaaatctttagtctcttctgctattctccaggaatatgcttgtgaaaagtcaagtatgtcccttaaagtaagttttgatattaatatctttcttttctgaacctttatttcttcttccaaatcttgaagttatctcagaaggatacacccttactcctgactgagaactctttgctcatatctactggatccagtttgttttgcccaatagaacaaaatgtcacgattcttttaaagttcttcctgggcaatagtgaagtgcctgtgccttgaatgtgtattgtttgcctgtaaatttcatcatttgtgcccaaggattagggcaattaaaacaacaacagcaacgaacaacgcaacagagtcagcgctttcagctcccactctcagataggaagcacacagccctgcctcctctggagggattgagctctcaggcgtcgatttcccagctgaccactagaggcgccccttgtgcttgtaccgcagttgctgccatcaggcttcgaagccgattgccccttcttggggaaattgtgaagactaaaaaaaaagtgtttcattttatggaaaaggaaagttagacatttgttaaatattaatgacattgaatgtgcttaatggttttgtggtgatgtagaaaagggtttctcaatcttggcattattggcaaactggaccggtgcatgctttgctgcggagagtgtcctgtgcattgtgggtgctgagcagcagttctggcctccaaccgccagatgtcgagagagcttttccttctcccattgagacaaccaaaaatgactctagatgccgccatgtgtcccccggcgcgcaaaattgccccctgtttgacgatcatggtgtgagacgatgttatcattaccagtagattcatactaaaatatttcagggtgaaattttcacagtttattttcagatagcttaatcagaattgaaaacaggataaaggcaaaaagagaacatttttgaaaaaagaaaagaattaaaaaaaaaaaaaaaaggaaatggaaggataagaaaaaaaactatgagagccaaaattcacaggccaggcaagtcacatcaggcctcataggggttgacaagctgcagtgttgagtgctttacacagctgggcaaggagtgaggacagcttctccatccatatgaccctgcttttaggagaggaatgcgtgtgatacaacatgtagaatactggagactcgagtttaaccacagggttatttatttaatgatgaaagagctaactagcagatgcgtattttccttgggcattacacagaggacttacattaaattgtcacataaaaaaataaaaagggtgagagaactgttctaaatttaaaaagacaaaaaggacatagttccagtgcagaggtcaaattttttcaagcctgttaatgacccttgagacctttaaatacggtcctgggcattagatttaattttgaatcaaagttaatattcttaggtgtgattcatggaattgtggttatgtaggagactgtctttattaggagatgcatgctaatgtatttggggaggatatatctatgtctttcaaatggtttaggagaaaaaaatacctgtaatatatacatgcatccaaaactatatataaacaaaactatatatatatgtatatagcttttgttttgttttcgttacaaatatatacgtttgcatacacgtgtatacatgtgtgtgtgtatgtatatatctgtgtttgtgtttgcatatccaaactgcatagaccaaatggctcataccaggtttaaggcgaaagcaagccctcagatctgcacaccctagtctaagtacagcagggtgtgtgagatggtgagacgcagttcaggtagtgcccatcagagatggagctttgcggtcagacatacctggattgcaatcctccttccaccagttaacaggaagttgactcttcatgggttttgtaactttgaagcctcagcaaagtggaaataacactttattttacacgaaatggttgtaagagtagagggagatcgcatatgtgaaaacatgtgtcacgcagtgggtgcctgctaatacctcttcccttcttttctccatgttaccccgacatgttacaaggtggggaagatagtgaatggtccacagtgtgaacagcaacctgtgggcatcctcaaatttgtttgcatctcatttgtgtgtacacggtatgttcaagcagagaaaatagcagaatttcctgatggttttcaatggtatcagcatgcttttatggttcgactttaggatctgatgttaaacgcaaggatgtacgcaaatgtttattagtttcttatgcatggaactggtgggttgctggtgttagaggctaatgtggccagaagatggcagtgcacgataaagaaaagctcccaggcgccagccactgttttaattagctaaaaggaagacaggtatgcttttatatagtttttgattttgtaattttcctgagcagccattgagggcagatgttttcatcttttcccccagtttaagtatcataggagagggaatatcaagatgcaatcaattgctggccacggcaaacctcctgaacttaagtcttgcaaacatcatcagcttgtgccatcttagaaattgctgcagtggaaacaggcatggagctatcaattacttctagggctgcaatcccctctgtccttgaaaaggaagccagctgattctgtgagtgagatgaggggacagccactggaatgggaggtggcttctttatcagtgtcttagaagttgatctggagccctagaggaagaaattaaagatcaccttaaattgtgcatgagggcctagccccctgtcgtgaatgaccgttaactggtcagcaaagtaattgaaacaggaaagtttggaggaaaagaaaaattccttaaagcatttcttttttctcttctagttgttacctttgtctttagagtgagtaatccttcatgcaaaaggagctagcatgttctctatacatacgaagtcctaggcatactttatacattttctggctttacttagggtgatcttcaattaatctctttggcaggttgtattagtaacattttacaaaatgggaaaatgggggctcaggaatagtgaggaacttgcctaaggctgcaggatgactgaaaatttacaggtgaaattcaaacctccatccctcatcatttccctatttcctgtccagaaaggaatgctaaataaatacgagctgtcaccttttatattccattccttttctttattcctgctgtacttactaaccaaaaataaagacaggaggtgttgttaatcattacactggcaataaatgacttcacgtaagtgtactaagagagggagagtttttcttttttttttttttttttttgagatggagtctcaccctgttgcccaggccggagtgcagtggctggatctcggctcactgcaacctccgcctcccaggttcaagcaattctcttgcctcagccacctgagtagctgagattacaggcatgtgccactatacccagctaatttttttttttttttttctatttttagtagagacaggattttgccgtgttcgccaggctgctgtcgaactcctcacctccggtgatccgcgttcctcactctcccaaagtgctgggattacaggcatgagccactgtgtctggccaagagtttcattttttggtcacacttaaaccaagtccagacatcatttgctagttacacaaaagtcatccatacttattgtagaacatttaaaaatataaaaaaggagaaaaacaagatggcctcatcactcaagaataccaattttaacaatttggtgtctgcccctatcctttttccctccaagcacctgaaattttaacaaacagccttcactcaatgttgttttcattatgtcatgaaagtgtttcctacaataataaatatttctgtcttaaagccaccattattaatgacttcatgtcctcttccatcatatggacattttctagtatttaaaaagcttttatttttgtacacttaggttgattccaacgtgacaaaaccaagcaggttctgtctagcttttgcaagacagaaaaaatactgcatattgacaaaaatgttatttgaaaatgtcccatatgtttggctgggcccagcgctgtgctcagcactgcattatttcatttcaaccgtgcagcagcagcagtggggactatcatttcttctacatattaagcagagagaatgtgaaggaacaaatcccttcgatgtaatcagacaggtttccacggttcagatgttcttatcactcaggtagaggtctcaaattagatgagacagtggtcagggccattcatagcaatcgaaggcgtctttcttcatgggaacttcacagatttgtgtgggcttagtctgagccctcgcccctcctcctttgctttattgatgcttcaggaagcctgtgggccattcagtttcatgtcgatgacagtacacctaagaactgctatgcgcaggcctccgttgtactcacaacgcagcttgtttttgcataatttaagcactacgtggttgtgtcgtttaagttctgtgaaattggtgttcttccatccatgaaattatatacatcttgggaacatttctcagttgctaaaggggtgaacacattcttcaataggggtgagacagcagtggagttgatagagcttcccccgaaagcacaggtatctctccttgtccttttgagacacaaaggtaagcattttcttctttaatgctaagggaacgcaattgtgagactaaccttcccattatgtttcaggccataactctttccttttctcccaacctcccccattacacacacccaacccagttaacacatcaagaaacccacagattgcacgtcctttttaaacattctctgcattgctgctactgtgttgtattttgagtgcttaagacaatgataatcttccaagaaatgcttttgattaatttgtgtacctgatttgtgtgtgtatatagattctgctcgtaatgatatgatgtgaaaatactcattatatataacaaaccaataatatgtcgtcatggaaaagcatggttaaactcatttcagaaatctttgcagtgttaaaaacaggaacagcaggtatctagttcctgaaagaatcacacttacagatgaagggcttttgttgttattgttattacttggggcatccatagaaatacagattatgagtatcctttgaattcttggttttaacatcaggtagtaaataccgtatgttctgacttagaagtaggagctaagctatgactctgcagaggcacacagagtgatataatcgactttggatactcagaagggggaggttgggaggagaatgtgggggtaataaactgcatattaggtacaatgtacactacttgcgtgacaggtttaccaatatttcagaattcaccactatataattcacccatgtaaccaaaaaccacttgtattacccaaaggctactgaaattaaaaatatgtaaagttaagttaaataattaaacttaaaagtggtgatctctgctagtcaggataagctagtctgtgcttcagtaacaaacatgtcctgatatcttggtgttttatcacttgcaagcttatttcttgccacataaaattaacttcaggtctaatagttctataagaaggttctcttccaaggggaagtgccaggattcaggctgctcctgtttcatctagctgtatttatgtcctgtatggtttttcaaagttgcagcggccggggaggacagaggatggaaggctcacagctactctgttataggtcagcccagagtggtcacatgacactcctcttactccctattggctagaacaagtcacatgggcccaacctaactccaaaggagtctgggaaatgtgtgctcaggaagcacaaaatgaatgatgacacagtgaatgcatgttatttctctccaccgtattttcaaaacaatcatcttgagtgagagcttcagaaatgaaagatgacacatgctaacaaaaccactcttggaaacatcttctatgccaagcactgtgctatgcacctcacctgttgtattagtccattcttgcactgccatagacaaatatttgagactgggtaatttacaaagaaaagagatttcattggctccgggttcagcaggctgtacaggaagcaccacggcttctggggaggtttcagaagactttcagtcatggtggaaaaaaaaaaagagaagcaggcgtgtcttaggtggctagagcaggaggaagagagagatggcaggaggtgctacacaattgtaaacaaccacatctcatgagaactcagtatcatgagacagcactagggagatggtgctaaaccattagaaaccacccccatgattcaatcacctctcatcaggccccaccttcaacagtgaggattacaattgggcatgtgatttgagcagggacacagatgcaaaccgtattacctgcattcttttatttagaccccttggcaacagcagtggggattttcattttctccatataagaagtgaggagagagaggttgagcaaagtaacttcccaagcaccgtagtggggacaataggagtcaaactgaagactaccagaggtgaagcctgtatcactgtccaaccagccatttgacctgcagattggtattctttattttattattattatactttaagttctgggatacatgtgcagcatgtgcaggtttgttacataggtatacacatgccatggtggtttgctgcacacatcaacccatcatctacattaggtatttctcctaatgccatccttccctagcccaccacctcccgacaggccctggtgtgtgatgttctcctccctgtgtccatgtgttctcattgttcaactcccacttatgagggagaacatgcagtacttggttttctgttcctgtgtcagtttcctgagaatgatggtttccagcttcgtccatgtccctgcgaaggatatgaactcatccttttttatggctgcatagtattccatggtttatatgtgctgcattttctttatccagtctattattgatgggcatttgggttggttgcaagtctttgctattatgaacagtgctgcaataaacatacatgtgcatatgtctttatagcagaatgatttataatcctatgggtatatacccagtaatgggattgctgggtcaaatgttatttcttgttagagagcttatcctctaaggctgattatgtctggagtttttgtaggaagtggttgcaggatcctgaggttgaattgtttcttgttttcatatgtgtttataattcacatgaagtgatagaatagactttgaaatataaggaaggtatttctcttaagtcttcacctccacatatattatatatgaaaatctagatttatttgatgtgggcaatagataatacttttttcctaaaaatattatttttatatggtaatttcttctcatgtgttttaaatactcatcttctaaggctgagtaagtgtatttaatgcacaaattttttttatgtttatgcaagagatgtttacacaggacttatctttcctgtaaggtgcctcagcctgtctatgacaatgtctactataaacaatatcaaagggtttctgtattttatatcttcctgaatgtagacatattccttggggacagttgtcatgaaaatcctctggaagtactttggtgacatgtccgtcattcatgttctgtttggttcttccctgaaactcccacaacatggaaataaacagagagcccagctgttttgtttctccgtcttcctacggggagagactcaatgcacagacttcttgagcgagggcagtaagctttgtctcctgcaaagacatttgtctctgaatgtggtttccttttgtttcatgcttgtgagtgtgtgcttgtgtttgtcaattgagaatcagcaacgaagaggtgtaagagttgactgttccccagagtataagggcaagctgatagaaaatcagctttgggtattgatgataaacaagttaatcttctttgggtaatcttttgaaaagaatccttgctttatttatttatttttgctttttttcctgttgggaattatccgtgagtgaaataaaaatgcttagaagatggtcttagatttcagcctctagcttataaggattgaataaatgttttattactcatgagttaaaacataggctaattcaaaaagagtttactttaaagagcatgactctctaagaagatatttgattttatcttattggaatactaggatgtggagaaacaatgataatatgtgtgtttttaagtgtgcttagagtgataacatcacctatgcaatatacgtttctagaaaagataattcacagatccattcgtgacaaaaattcatataaagggccatcacacttttaaaaaaatggagggactatttgaaatgcaaaatgattttgcctactatagtttaacattaaagaaaaaaataaaattaacctatttgtttaaaaaaatagtatataagtaaaaggcaaacaaaacctcaaagatcatcgtttcaaaactatactgagatgcaggatgatcttatgtatcattatttagtaagaccaagcagggattggttgattcgttggctgcttaggaatcataaacctctgcttttagtcgattatagtacagtaggaagtgggttgaatcaaaaacaatatttctaactccaggatatttcaagttcggtttggtttcttttctttctttctttttttttttttttaactttagaagtaccatgagccaagaaaggtagtgtccccaggccatcattttccttcctctaaattcacattactgaatttttccccccttggactctgaaacataatcaggggaattggcaggtttgggttttcattttcacctccggctaaatctgtcaacctgtgatgaggttggctgggcatcatcaggaagcgaactgttttcctatttgtagagtggaaacaagtaccagcgcttgcagcttccagtcattttgttattcatgttacatcatgttccttctgattgttaacatgacgatgtcactgtgtcttgagagatgttgggaaaagtaaaagggaattacagagtcctggaaagaaatctcccaaccatgtcttttgtatcaaaaagtgtctgctattagctgtgggggagctagatgtcactcccatcagaggatggttttctgtccctataaaattattcccgtgtctatacagagcatctcgatgtgtgcgtgctgcagaggtagggggtggcagagctttaagcccgtaataaacataactgtttcttaagaaagcttattttgccatcattcttcactcttctctgtccatttccaccttcccaatccaaacttgtcactttcaacacctattaattctccttcctcagtacctttaccatctattcctttttctttattttttttgtggatgccactcaagtttgggaagtaaaatcattctgagtaaatgcgtttcgcaggtttcccgttatcacattacacgcgttatatgtatcatttgatatcatctttacatcaatcccaggaagaaagaatgtgtgcctccactgtttaagatgaccttggcttacaaacgtaaaatgaccatggcaggtaggataatggtcctccaaactgtccacgtcctaatccccaggaaccatggatatgtcaccgcacatggccaaggaattttgcagatatgattaagttgaggaccttggattgaggaaaattaattatccagataggctcgatgtcatcccaagggtccttgaaagctgagcacttttccttgctctggtcagaggagagaagtgacagtggaagaatggtcagaaagatgctacttttctggttttgaatatggaggaaggggccatgggccatggactgttggtggccttttgaagctggaaaagttagggacatggatttttcccctacagctttcagaggaaacacagccctgcctgttgacaccatcatttcagtccagtaaaagacaagtcagacttttaatatacagaactgcaagataataaacgagtagttattttaagtaagtttaattaagtaagttagtggtaacatattctcctattttacagatgacaaaaccaaggtaactataaagattactttgttacaagtttagcatcaataggaaactaactcagtgacctccctgtaagatcacccagggagtaaacgtgtgtctgagctgtggtttggattcatacctctctaacattaaagagcagatgtcgttttcactaagtgtttcatcttctttatttcttacctagatccttgaagtcatttgatacctggtatctctccctagagttcctctcatttaaatccatcctactcatcactggtacattattcttcctagaacattgaaatgtttaactactttccgtgaccctgtggcctaacaaagaaacaaacagcatgtgtcggcctcctggttcctctctgaattacttccacttaagttgttgattcacctacactctagcaaagctggaaaatttttgttgtcctccttccaccatgcacttttccatccaaacacatttttttttttttactgtttcttccacctgaatgtgtttccctttaaccaacacctagttgaaatgcctactatatactccaagtcagagtaatgtctttatcttctgatctgtttcaacccacctctggtatcaacatcatcatcatgatcattgtcactatcagtactatcactaccatcatcatcaacattatcttcatccactaccatcaccaccatcatcatcaccatcctcatccattactatcaccaccatcattatcagcatcatcttcatagtactaccatcaccaccattattatcaacatcatccccatccactaccatcaccggcatcattatcaccatcgttctcctccactaccatcacaaccatcatcatcaacatcatccccatccactaccatcaccaccatcattatcaccatcatcctcctctactaccatcacaaccatcatcatcatcctcatcctcccccaccatcaccatcatcatcaccatcatcctcctccactagcatcaccaccatcatcatcaccatcatccgcatccgctaccatcaccaccatcatcatcaccgtcatcctcctccactaccatcaccaccatcatcatcatcctcatccactaacatcaccaccgtcattagcaacatcatcttcctccactaccaacaccaccatcatcaccatcatccgtctccactagcatcaccgccatcatcatcaacatcatcctactccactagaatcaccatccccatccactaccatcaccactatcattatcaacatcctccttcactaccatcaccaccatcatcatcaccatcatcctcctccactaccatcaccaccatcatcatcatcctcatccactaacatcaccaccatcattagcaacatcatcttcctccactgccatcaccaccatcatcatcgtcatcatcctccactaccatcaccaccatcatcatcaacacatttttattcactaccatcaccaccacaatcatcatcatcatcctcatctgctaccatcaccaccatcatcatcaccatcatcctcctccactaccatcaccaccatcatcctcatcctcatccactaacatcaccaccatcattagcaacatcatcttcctccgctgccatcaccaccaccatcatcatcatcattctccactaccatcaccaccatcatccttattcagcaattctttagtgttcacagagtgccatatacaatgttggatcctttatgagaatcatctaattgactgtttacccatatgaagtagacactattatttctcctattttacagatgacaaaaccaaggtaactataaagattactttgttacaagtttagttttctattgtaatataggcatgtgtttgtcatatgtcactactcagatgctgaaatgtttgaaacaaatttcaataattcaacacccaggtttggagaagagtttcatcttttgtttaacctcatcatgactctgccaactgttggagttttccttgttcctgctaaataatccctttagggcaacttctattgcatattgtcagtattccacccattgtgcgattctccaattttgttaaattagagaggaggttggtgtgtgagtcaatttttctgtcttatttatcttgacaaacaatttaagagattatctggcatttggagttggcggagattaattatgtagattatatccacagttctcatccaaattccactataaacacaagaagaaaaaactggttggtcttaccatgtgaacatttcattttggatataaagagggaaatgaaaatgttgatgatccaaacctgcctgacccaaggaaattcctaagtgttttagttacatgtccttgaagttgtttctttacacattttgttcactgagggcctctttactggcttgggtgcaggaactcagtctcatgtttgccatcccaaagttctgccttacactgtgttggtcttatcatggccattgtttttccacatggtagcaagatggccaccaggagccaccagctctatcatatcctcccagcaactccattggtaataggtataaaaatgaattccagcattgcctctcatttaactaattcagggcaagggcttttccgtgcatcagtcactgtgacggaacacagtgattggacagacctggtctagagtccagccccggagccctgggaaccacacggcaacacacagaagacagcatgcgtggtaaacaggactaacacttgtcagatctcgggggaaaggatgttgcatagttcagtaccacaggtgtcactgtaggtgaagggaaaaaaatgacacatagacattctaaaagctgcatttcatattaaatcagccaggctttgatgcatatggagaagaacttttagatgaatgctatttcagaaagcccttgtcccagtgaatattactgtgtgtaaaaaggaaaaaaaacaatggccgggcgcagtagctcatgcctgaaatcccagcactttgggaggccaaggcggttgggtcgcctgatgtcaggagtttgagaccagcttggccaacagggtgaaactccgtctctactgaaaataaaaaattagctgggcgtggtggtgagtgcctgtaataggtactcaggaggctgaggcaggagaatcgcttgaacccaacaggtagaggttgcaattacctgagattgcgccgcttcactccagcctgagagtaagagagaaactctgtcaaaaaaaaaaaaaaaaaaaaaaaaggaaaggaagggaaaggaaaggaaaagaaaatgacataattaaatgtatctggtcactgttggattaaacaagtttctttaagatttcttggagcccttaagtggccgacgcgcctattatgaatgtttcaagtatgagatatagaatgatgagcactctcaatatattttcacttggaatcttctttagggagaatatattgtaaaagacgatcatagtgtccggcctattgttagtactccatagatatttgtcaagaaagtgaatgactgtcacttattttggaaaatatagttcaagaatcatgaatcctctctgtacttcttgtagcaaaagtaaataacagttctttgatatcttcattgtcatgtcctgttttgtttgttggttttgttttccctgctggaaatccaggtggctcaggatgaacatctccatatggccgtgaatctatgggaggaaattgcatatggtgaaaatagtggacaactgactgttccttttataaccacattgcaataagcttttaaagagatgtacagacatacacacactgatctgatttctacagcgtatccacttaaactggcaaagacgtttaccttgcttgaggcaattgttgtatctagaaaactgtgaaaattgaattaaattacaggtagaatacactggggagctcattactaaatggatcctatactgcgtgtttttgtagaatgaggaattatttcataaaaggaataatactctctagttgatataataaatatgcttaaattgaggtatacaatatctgtttgtaccactattacaggcacataattgtcatttatttaaacttatctccaaactaagtgaaatatctctgactttttcttagaagttttctttggaaaaaaaaatttagactagcactttctttataatatgcagtgagtcttgttttatattgaaacctcaattcattttcttcctagtgaaaaatgctttttcatcccctctgaaataaatataatctttgaaattggagtcgatgtaaatccagaggtaatgagattcagtttttcattgtagccgaattagatggagaacttcaaatatttatttgaggtttaattcgagtaatttaggaaaacattgagctttctcattcataaatgataattacgtctcttcatcaaatattatactatattcccttctgctatctgtacagtctccttcagatatgaacagttttatatctcaaaggagattttttttttccatgtaacttccttggcttgtttaacttacaaaacctttcgaaatgcagtttgctgtgcctgtgtttggagtgtttagttttgtagaaaaaaagaggtgagaagtagaataacatttacattgattttcttcaaggttgtgctctactgagaaatagtattttgtcttactaaagcacatgtttaagaaatggagattgctgtcttgcaaaacccccaatataaactccagcaggctaaaatgcctgtagcctctagttgattataattctgtaccaaatcaaaagtgactgcatttaaaaacttccataaagaaaagcttagacatttcaaactaatgcttggccaatgcaaaattatttattccttccccttcagaatttcttctggggaaagccaaagaaaaatcatatgaattgcttgaagatattcagggattgactagagaaatagggcctctaccttggtggtgatgatgttatatattataatatgtatatatggtatagtggtcactgtagtggtagctgcagtagtggaccaggtttttaaattttctgcatcttaagtccttttccacccactgtagtcatggtacttgactttggtcactaagcttgccagaggaagtcatattaagtattccaccagccagggatcctttgggtgcaagcaacagaaacccaattcaaactaccttcaacataaaagggaaatatactggctcataggaaacagcccacggtgagactgacttcaggaattaaggaatccaaaaactaaatgatgtacagaatctaatatctccttataaatctgctttccattgtgtgatcacatggtccattctcactggagcagcttgagtcaaaggcttatcctggaactggtttctgtgttggtggatggaatgatgatgtgggagcaccaagccaaggttatttgctcacctctggattaaaaggggaagaaaaccccatggcgaacaaatgaagtttgggatgatccttccccaaagaaacaggctgttgtccaaaaaaggaaggaaaacagatactgagcaaaccagatcaacagaagacccaaccttggtattggaagtccatatctctacatggcccacctttagccttctccagggacaccagatctgcccagacagtagaagaacaattgtaatcaagggtaggatgtggccagaagaccaaaagtctctttttttaaaacatctgttctattaaggaaccaaccagagagttgattggtctatggtatgtacttatgtcttaactgatcaaacttattatcctcctcagtaattaaactaactagaattgtctcttgtcccactgcacactgtctgtgaatttggagttatttcaactgtttggaaatcataaaatatgcattttgttactcatgaattaagagctagaaaccagaaatccacttatatttcttccacctcccttaaaattttactttccctcgtgctccaatttgacaattagatcatgtaaatatcattatgtaaaataatacagcattaagatgtccacagaagatatggggggtaatctatttgtacatctaaaccagtccatttttctaagatatatgaggatgtgggaaagtctgcattgatcttcaagtgcaaatttttaagagaacacaatggatggtttagctacaaaaactagagattcttaagtaagaccattcttgtgaagttctcctgtggccgccataacgcaaatcaatcctgtcattatctcttcctgggctgggccctgtctttccccatgagcgcttaactctttcttttgtctcttcaaatttttgtttgctcttctgaagtcatcatcgtcaattagtatttgccagagccccacagggtctaacatgccacttctccatctgttattcaccgaggcagacgtggtgggaccaccccttttaggttagaatcacattattctatgctattttcagcatctcccacctgctgtcctccaagccgttctcaaatcccacatctttgttctgccctgttttcctcccccacggtttgactttctaagcattatgcaatggtgagaaatgtgaatcccttatagtgatatggaattccatgtcccccaccttctagttaatatgaccttggagggtttttggattctttgtgatattttcccccttattcataaaagaggcatattgaatgtgtccatagcgtacgaagactctagaacaaggggtgatgattgtgaaaatgagcttaaagctagagaatgtggcgttgttcttggtacacattaggtactaaaaatgggtgtttctgttattaccttagggattcaagtaggcaggcaagtgacaatcataaccagcatgcagccatcatcagtataagaaacagcgtcttcaacccatttgaagtgccacccaggcacccctgtcatgtcagtttttaaaccatttttatcagtatgcaaggcagcatatggactactgttctgggaccaccttagccttgaactctcttcacgttcactgttgtgaggctttgccttcatagttatcctccctatgttacttttttttttttttttaaagtgactttcaggatcagtgactaaaataaggttctctgtaacagtcataataagcaggtattttttatgcaaaagtggtgtctttcagagtccagaccatgctgcgtgtctttgaaggagaagcctgcatttaaaagccaagccattttgacaatattaattcagttaatttcagcacattatataatgtgtccagtgacctatcaacgctgactggttgggcactccagtaacaaacaccaaagcgagtgatatgtcataacagacaaatgggctctttaaactgtacgacgggaagagtgtttttgttggcatgaatactcatctgtcaaccagcccctgccctgttctgatgatggacaaggcattgggttaacacagaaggacataaaatgaatgatcaggcatggccgttgccttgaaggagtttatgatcaaggtgggataatgaggcataaggacatgaacacatgcaggcacggtgaagaaaaactcatgatggttgtatgtagataagtgtcaaatgaggggtctgggcactaaggatagctattctgccacaagtccttcaatttgggcccaaaggtaatgttaaatttgtggacaggtacacattgttttgagttattgcatcaaaacataatttgccctggtatgtggatgagctagctgacatacatgttttcagggtatcttttccttctcttacgattggcaagaaaaagcttaaaacctctctctcatcaaatactctcccccactcaccgtagcatccctgaataaaccaggtgggtacctggaaattgtagaggcattcccctaaggtgatgtatttgatcatcagagccagagtcgggggacttactcaatttttcacccagagaggaacgtgagaagtgtaccatgcactgtcctttcctgatctcagggcttcctctcaatagctgaacccaaggcttgttgaaatgaaatgaaaaataacagtataacatgcttacataaatttttaaaacatcagcaccataggcaaggttaaaacaaaaaaaaaaagaattttgaccaggtgtcatgtctcacatctgtaatctcagcactttgggaggccgaagcaggcggatcacctgaggtcaggagttggagaccagcctagccaacatggtgaaaccctgtctctactaaaatacaaaaaatcagctgggtgaggtggtgggtgcctgtaatctcagctattcaggaggctgaggcaagagaattgcttgaacccgggaggcagaggttgcagtgagctgagatcgcaccactgcactccagcctgggcaacaaaaacgaaacttcatctcaaaaaataataataataataattttttaaaaattaccataagtagattcgtgaaaccgagtcacctggtaagacagactttcttgaaactcaaaatttcattactacatttaccatgttatctatggcatatcccagcaagtaattaaaagtagtggttcatgacatatagaatttatctagtaatgaaaacttgcactaggagtgtttttaatgctccaaatatcctctttacccaatttgctagtcacgtcctcggactacttaaccattgttcgaggttgggttcacagataatcagaaggcattgggggtaccagatgcttatgagggatccataccagtaaaagaaaggagtagagagcagagttgggcagaggggggggtgagtcagactatgatgtgagcctggaaagcctcagctgacccattggggagctccagaggtgaagagtttatcagtgtctctgtgtgtgtatgtgtgtgtgtgtgtgtgtgtgtttgtcttgggctgaaatggctgggactttacctcctacctctctcagtcattggatgcaagttgccccaggaagggtgtgatccttgagcaaggaggctctctgcagctgacgcaggccctgaaggggctgacagctgtggctgcctgctgacgtcaccccctgcagctgggtacgggtatttgtgagatgcatctccctgtttaccatcatcttactgactccacaaagtgggaagacatctgcattagtctgttttacattgctgtaaaggaatacctgagattgcataatttttaaagaagaaaggtttatttgactcttagttatgtaggttgtacaagcatggcaccagcatttgctcagcttctggtgaggcctcaggaagcttctatttctggtggaaggtgaagggggagcaggagtgtcacatggtgagagaggaggaggtgccaggctctttataaaaatcacataaaggcgtacgtacacctgtgttcattacccagcactattcataatagcaaagacatggaatcaacctgaatgcccatcagcagtagactggattttaaaaatgtggcacatgtacaccatggaatattatgcagccagaaaaagaatgaaatcgtgtcctttgcagcaacatggatggaactggagtccagtattctaagcaaactaacataggaacagaaaagcaaatactgtgttctcacttataaatgcgatctaaacactgagtacacacggacacaaagggacaacagacaccggggcctgcttgaggatggagggtgggaggagggtgaggctcaaaaactacctgttgggtactatgcttattacctgggtgacaaaataatctgtacaccatacccttgcaacatacaatttacctgtataacaaacctgcacatgtacccctgaatctaaaataaaagtttaaaaaattagacctcgtggtaaatcactcattacagcagggacggaaccaagccgttcataagggatctgctctaccatgatccagacacctcccagtagacccacctccaacactggagatcacatttcaacatgagatatggatgggacaaatatccaaattatcggccagccgtggtggctcatgcctgtaaacccagtactttggaaggccgaggcaggcagattacctgaggtaaggagttcaagaccagactggccaacatggtgaaactccatctctactaaaaatacaaaaatctgcctggcgtgctggcatatgcctgtaatcccagctacttgggaggctgaggcaggagaattgcttgagcccgggaggcagaggctacagtgagccaagattgtgccattgcactccagtctgggtgacagagcgagagtccatctcaaaaaaaaaaaacaaaaatccaaattatatcaacattctattccttcccaaaaagttctgctgaagactaaatgaggtcatacttctaagatacccagcccagtgactggtgagaataattgctcaataaaatcctgtacggcagatactgttctctctctggtttttgttttagtctttagattttttaaattatttttttgttatggtaaaatagacataacataaaatgtaccaccttagccattttaaatgtagagttcagtggcattaaatacattcacattgttgtgcgaccatcaccaccatctgtctccagaactttatcttccaaatggaaactttgtacctatgagacattaactccccattctcatgtcctcccagcctctggccaccagcattctgctttctgtccctatggattcgatgttctaggtacgttatctaagtggaatcatatggcccttgtcctttggtatctggcctatctcacttgcctcaaggtttatgttgtagtgtgttattcttatttccttcgtttttaaggctgaataatatttcattgtgagaatatatcatgttttgttttgttatatcatgttttgttcatttctctgttgatagacatttgggttgtttccacctgttggctactgtaaataatgcttctattaattacttattattatttattattattacagagctgttaatttcatttcatagataagaaagtggctgggagtggtagcttacacctgtgatccagcacttagggaggctgaggcaggaggtttgcttgagcccaggggtttgaggccagcctaggcaacatagtgagaccccatctctacagaaaatataaaaaatattagccaggtatcgtggtacatgcctgtagtcctagatgctggggaggctgagatgggaggattgcttgagctcagcagttcaaggcagcctaggcaacatactgtgaccctgcctctaaaataaaaataaaaaaagcctggtgtggtgttgcacacctgtagttctgacttgggaggctgaggtgggaggatcacttgagcctgagaagttgaggctgcagtgagccatagctgagccactgcactccagcctggatgacacagttagacccagtttcaaaagaaaaaaaagaaaagaaaaaagaaagtggctctgagagttcaaggacaagaccagcaactgaatccacatctgtccaacccagattccaagctgctgactgccatctgggtggcttcccctctctgacaaggatagccagcaactctgaaaagcaacttactctgttacacctgaggctacagcagactcctcctatctcatagaaaagaggcctcagcttcccagcctccagcaaagggaattttctaggtcccagtccccctgctttgattttaaccctctctgtgtctctctcctctgacttctacttccttgctctccatctaattccccctcctcctcgagctctttgaagttgagggagtctatactgccaggcactatccttgctcttctaatttcttaattcatttcaccttcctcctagccccatggggcaggcattgttattatcatccccatgttgtgtgtaaggaaatgggtcatgcaggagttaaaaacctgcctaactttcacgcagctagtaagtggcagaactgcaaattgaacagccagtccctgctccacagagatatgcaatgctacctcttgagctaaaacagaaattcagaccccactttgtagacacaatggctcagatttaggagacgaccctgcagccaaacctagacaaacatgaggtggttctgctgtcctgagcttgctgctcaccgtctctgcccacatggctctagctgggctcaggactttcctcttcacagcaggctgaacagcaaacccagaggccattgcagctgcctcggtattctacaccccccttgggtctggaagttgttggaggcaggcataccagactgtttataatatggatgctttctccttcacctagctggagccaagaggggtgggggaagactgagagagacagagacagggagagagagagagcctgcctaactgcctatttatcccaaatccatatattattttggaacattcagtattgcagaaatacatggagggataaatcatttcttctgccatctggtctcggagaaccttcccaagaactgtagcttcgtttaattttgctgcgttcctttcccaccctctttgtgctttccatcatcttttcttggctgtatttttgggtttgttttgcttcagtttcttgctcttttagctgtttctggatttcaatttttaaaaagaaataacggatcgcacttatccaagtcgtgccagattctttatttgggataatgctacctcatggctattttttaactttaatccggaaccttggagtgacgtgtggatttttttttaatgccccaaccagatgcactaagcagcttgatggtcagtaatgaggcagcaccaggaccctgtggtcctagagtttcttggcagtgccttcatggcaaatgtttcagtgagatgagcgtggcagacccagcccagccattgctctatggttccaaagtccttttaaatgaacaaatgggttggcattcatctagtgggactgcaactccagtgaggttactcaaaacatactgggcaaaggtttctcactgtttgagtgggaggttacaagggaagaagtctagagcgatccatggcatgatggatgggggttggcatcagaatgaatcatgtttagcttaattgggacacagatggttaagtatagaaatacctacagacatacatacatccctgggttactgtacacatagatcttcttgttccgtcagtttagaggtcctggaagccacaaccccccagcagcaatgagcatgcctactacccagatctcagtttctaataccattctccaaaaagggaagaagggctccttggagaagcggctgcttttaggactcagctatgaaatatacaagatgagcctgatagcaaatattttacagtgcaagaaagcgctcacaacaacaacaaagccactgtgatagagtatgtcttataaatgagaaataaagagggataaaattataaattagggcctggcatggtggcttaagcctgtaatcccagcaatttgggagcccgaggcaggcagatcacttgagctcaggagtccaagaccatcctggctaacatggcaaaaccctgtctttactaaaaatacaaacattagctgggcatggtggtgcatgtctctagtcccaactactcaggaggctggtgtgggaggagcacttgagcctgggaggtggaggctacagtgagttaagatggtgccactgaactccagcctgggtgaaagagcaagactctgtcttaaaatatatacatatatagatagatataggttagatggacagaattgtggaccacctttcacgcctattaaaacccggatgcttagccccagtggctggctttgtacaggcattgtaatctttgttgtgtcagggtttgtgttgaaaactttttactgctcccgtgaataggtaagccctaaattcctctccttaggttcacaacagcagtggctttcctggtcgcccatgtcccagttttgatgatagggcaacttgaaactaaaagagtgaaaaataaatcacatttacgaggagaaaatggagtcattgcaactcaattattaatgtgcaaaactgttatgcaatgtagcagcccaattaataggtgtctcttggggaataatcaaggcttaatttggcatgataattagtagcctccccttccagctttggatggggggcccctgtaggacagcctgatggctggtaatgaggcaggatcacttactttgcagccgtgttaattgtatctttctgtgcatggggacaaaacagatttacctgtttctggatgctgggatgtgccattgctctaatagagttgtacttgtttcctggtcttgccaacactggcctttctgaagggcaacactgttacacttttgagacgtctttaattggctgagttgttctaatggctacagctgcagtcttttttttttttttttaatagagtgtgtggcagagttccaatcttacaagacatacggccagagctgacatattcttaggaataacagaaaattgtcctgtttagggtatctgtaataataggtgaccagaagtcatctggtgtaggtatctatctcctctatgtgtctcagagaactcctgttttttgcaatattgctagttgtttgtacaagctgtatagtcacttaaaagaaaaccatgaaaaattacaaacgtgtggtatttttactgacaaatgtggaacagcacagagaagaaaatagtatatcatctctaatgatccatcagccgagggataaccactgtcatcattttggtataatctctttccagacttccatgcacacacacatttctccccatatatatttaatccagatgtgatttctatttgcaaaaaggaaattgtaaggtgcatactattttgttaacatgtcgtttgatcataggaacagattttgaaccagatcaataccagcatttcctaaacggtcctcctccaatatttgggagctgctgatctgtgttctgaaagtgaggctgagacagacgcatttcctctcctcctctaggtaacacacaatgaacattcatatttcaaagtctttgtttacatgttaaaaacatcattttagggaaatcatacgttaacagctcctacaattgtcttccttaaactacatgtgggaaaatgctagtgaatatttagatggcttcccatttttgttttttttttttttttgctgttgtaaacatcactgcagtgaacatccttgtacatgcatcttggggcatttctaagatttccttagaatcaaccccaagaaggattgacagtcaatggacatactgaattgaagatgctggatctccttggatgaactgccgtctccagaaaggaagggcatgtacatttacaagcccaggagagtgataggagagtgcccttcctcccagtttctgctccatagcacatttttaattccagattctgcaactttagtagccgtgtaggagaccaaaagagaaagtttattaaattcttatttatgtgttcaatttgcatccgccttctccttccccaagctcaaagcgccacaaagaaaacattaagcttgtaactcttggatgtgctcctctgtgagagagggacttaggggaagattcagggaatggagttgaggaaatagtgcagaggtagaagcaggatgcattgtaaaagaaaacctagacatcaggtagtgctgtggagggtttcaaaaccttagtttcagaagaaaggcccttttccatcgtctttcccctggcttcccttttgaatggtagtagaagaagccacagtgaacagttggcatcttttgtttactacccacagacacctggcttggggagcgggggatgttgggggttatgacttttccccttgtttcttattaagccccctcctttgttgttgagtcctccctaaatggtcactcttatttattatgttgaaagtcattgtgtgggctaggatagtcccaaagcatttttgaacacacacacacacacactcacactcattcacaaaaatcactgtcttcccaactaccttgagaccatcttctgttttcttactttccatcattttttcctaaatcagacaggagttaagttctaaaattataggattttgtacctgtcatttttgtgaaaagtgttcctttctccacatgctgcccaatgagggtcctttaagatattttcatcacgttcctcttgctcttgtgttggacaatttcgcacaaatatgttttttgcccaatgatttaagatgctcttaattgcttttactgaagggaaatagaacaccttttaagccaacagctgagcgatttgctatgacaaatctgccactatgcattcacttaatttccaattaatcaaacattcaataaatcattagtataattacacctgttcccttcttgccctagcccattagctcaactcaggcgtcccttcgactggctgtggggaaggtgttcatttgtctgccctggctgggtgcacattcttactccctgtgagcttgagaaatgatgagtaagaaattgtaattatttcaggcaccagaagtttgcttggttttcctcttctctgcttcccactccattgcgtccccaacagcttaagccaacatcatagtggcctagtagcggtggctggttaatttcagcaagcttttcttttttttttaatcatttttattccctgactgtgcctctttgctaattacaccatctccccaggtgagcaataattccctcatcaccatatatctcaagcacagattattaaaataatacagcttatgtcatataaatgtaacagaaagtatcttaaagatgctttattgaaagctggtaaattggttcaacagatgaatgttttaaggcctgtttttaaaaggttgcacaagtataaacccactgaattactgctgcagtttcacacgagcggatgcaattattttaagcatctaactgtgcagaagacagatctgaaaggcaaggagctaaattctccgagattaattaaagggtttcattttgctcttgatttaaaaataaatttcaagcatgcatcacttgttattctgtggaagaatttgcattatggggtttaaaaaaatactgagaacgttaagtttcatgagttcttcatacaatatagctgacagctcttaaaaagaggggttgacctactgttgcagcagcattttctcctacatacttctttctacttttacatttgtgaagggtattaatcttcaaactcatttccaatgtaagattgtgcatttacatgaatctcccataagattgctcctgattcgatctatgcttattgatttaatttcttttacctctcagagccagtggtgctgaagggtttattgtaattacagtgttgcgggtttcggtggaacagttccctggtaacttaagtgtgggtttgattccctctaaactcgctcagcccaggagatactgcggcaagtatcttggaggcagagagctttcaggccagatcagaacgctggctggtacacaaccggaaggtatggggaggctggagagggaacggccgggggctactggccagatggatcgctgttctaacggggcccttttgaggtgaatcacttggcaattttgtgagttggcagacggcacagccacctgtgctcaatgtgaaatgagatacaggtaacctactgatctgaaatatgctgctcaccctttgagagatgggacagtgttgcaagaggtgatttgccctatttgtggggtattggggagggaaccacagcaaaaataccatgagttttgggactgaggggagtccaaatccaagccgtgtgtctctagaactgtagtttctaatttggtttaacttctcaaaactgaaatgtttgtcacttattttccttaacttctcaaagccaaattgttcctctgtaatagcattgtctagaagaacatgattaaagctgcatatgtacttttagttttttaatgactgcattttttaacagtaaaaataaacaggtgaaattaatgcattttatttaacccaaatatccaaagcatgatcatttcagcgtgtgatcaatataaaagatattttacattctttttttcatcctaattttttggaatttattgtgcgtttcatgctgacagtgcacctccatttaaactagccacattccaagtactcagaacctcaaaaggtgatggttactttatctaaaggtgcaggtctggctgatccgttaccggaatagtaccatttgcaactgaaagaagcctaattcaaatgagctacagcaagggaagaaaaattgtctcaagtatggctgaatccagaaacacacctgctgcagtttggaaattccccacatcaaggccctgcttgccctcgggtggcccattagatggcaggaaaatggcccttggcaaccccaagccttaggtggcccttaagtttgtgacctcaggaaatgagagatcctcttcccctgtaactgtagcaaaaacaaatttggtgaggaaaaggaggaaagggacaggcttcatttgtgccaagtgtctgagaagactccttctagaagacagggaggggatgatgggcaaatccatgaaggctacatgtaacgggagtgcaattccccaaagaagctctactgagcggaaaaatggcacatacccattgcaagtgaaatgatacaatctgccttaaaggttgtggtaaggattgcttaggccaaaactctggagtctttcttgacacttctgtttctcaaatatcatgcgtctaatccctgctgcaggaaatcatgttggctttagaatttatccagaattgtattgactgccaccatggggaccatcatcctgagcaggttctgtcttttcttgcctggattatcgcatcctcctcctaactctgctttcactgttttgtctccacacgcccctccccccatggcttctgtctcactgagaataaaagaaaaagtccttgaaatttttcacaaggtccccacattctggtccctaccaactttgtcatctggtatcttgtcctatctctcctgatatggtttgactctgtgtccccactcaaatctcatcttgaatggtaatccccacgtgtcaagggagggacctggtaggaggtgactgggtcatgctgttcttgtggtagagagtgagttctcacaacatatgatggtttaaaagtgtttggcagttctgccctcactctctgtctctcctgacaccatgtaagacatgccttacttccccttcgccttccaccatgattgtaagtttctcgaggcttccccatccgtgtggaactgtgaatcagttaaacttactttattaagtctcaggtatgtctctgtagcagtatgagaatggaccgatacactcctcactgagcccatcctgtctcaccactctcattctagacttcgttttctttcaagatctttgcattgtctatttcctctacctggagaaaccttccccaggtacccctaggtcttattcctacccaatttgaggtctttactcaaaaaccactgtttcagtgaggtattttatattgaaaattgccttctcctacatttcttgtctcccattcttcctttgtagctgtagcattttgtatagtatacgttttagtgattttgttatctcgctctctttctctgtctcacatatactatatggtaaagtccatcaggaaagatatttctgtgtggtgttacattcctctacctagaacagacttattagagaggcttaacaaatatttattgaatgaatgaatgatggaatgtagaggtgctcaatgaacagtagccatcatcattatttactatcagaggctgtttcagctatggtcagcaaggttaaaactcaaaatggaactctgctatgaacccttaagtgtcaatgccatcagtctacaaggtgttgcaaccttctgtcatctgggtctgccaaatacccatttgcgcatgtgtgcccgagaccacgttgttgaaatgttacgtctgtcctgggcgtgaactagataatctgcctaatgactgggccacagtaataggattttcagagttttactgtgtaccatcctaacctttcctctcatctcccgaggactattttctcccagttttttccatctcagtggatggtattatcatctttccagtgacacagggcatcatcttctgaaactcaacacccaagcttcagtccaatgtcatccatggcaagataatataatttaatcattcctttattcagaaaatgtttattaggtcctatcatggcgtaggcactctgataggcatggcagccaaaatgtctcctaagtatctctgaaaacatacccacttctccccacctcccctcctatcacctggcagctggactataaaatattccacttaccagttgatatggtttggctgtgtccccacccaaatttcatcttgaattgtagctctcatcaccctcatgtgtcatgggagggacccagtgggaggtaattgaatcatgggggtgtttttttttttttttttttttttttcctgtgctgttctcatgatagtgaataactctcatgggatctgatggttttataaagagcagttcccctgcacatgctctcttgcctgccgccatgtaagacctgcctttgctcctcctttgctttccaccatgattgtgaggcctccccagccatgtgaaaccatgagtctattaaacctcctttcctttataaattacccagtctcaggtatttcttacagcagtgtgtgagaatggactaatatgccaatcttttgttccctcccagtcttgcgtatcttccatccatcttctgcctagagccaggataatcttttccttctcacatgcaactctgaccatatcatacctgggtttttgtttgtttgtgtaataataacagtcccccattgctcacaggatagtctcaaagtctcacgggagtcttgatgaccaagttaatgccaacctccacatccccatctctcaccaaattctgtttaagctctaatctccagtctaagatttctcaaccttggtattgggacatttagagctgaataatgctgtgctgtaggggtctgtcctgtgcattgtaggatgttgaggagcatccctggcctctacccactagatgcaagtaaaaccccctccccagttgagacaaccacaaatctctccagatattttcaagtgtccctttgtgggcaaaaataaaaatccttcctttctccattgggaacaacagcttcaaacaaaattgaagttacagttgcccaaacatcccctgtcctcccttgtttttagacatttgcagaacctctcttcctctctctttccacatctacctccttagttatggctggcaactcctgctcacccttcatgtttcagttttgacaccaccttctggaaaagcttttttagacttctcccaggtagtagggtgatggcaagatccttggtaagacttggggactgatagcatgtggagaatttggacaggaagatatcatccttttctcagctgggttctgccagaagcagacctgaggcaataattcacatgaaagtagttgatacggttaggctttgtgtacccacgtaaatctcatcttgaattgtaatacccatgtgtggaggaagagaagtcattggattgtgggggtggtttcccccatgccattcttgtgatagtaagtgaattttcacaagatctaatggttttatgaatggtagtttttcctgcactctcacgctctctctctcacctgccaccatgtaagccatgcctgcctcaacttctgccaagattgtaggtttcctgaggcctctccagccatgcagaactgtgagtcaattaaacctctttcccatataaatgacccagtctcaggcatttcattatagtattgtgaaatcggaccaaaacagtggtttatttgggaggaaacactagtgttcatggtggtggtggtagaaaatggtgcaggggagaaaaggccacctgcagaatttattttgtgaagccactgaccactatatggaagtgaagctttatcccactacgggatccttggaaccaacgtacacacatagcttagtattatcctacccaagggcagggggcctggggtacttatactgcaagtctcattagtcattggtagaggggttctgcttttcctgctgcacaggtaggaaatgtgatttcagcatcaagaagaaatgcaggtattgaagatgaacatattacagccaggtccatgtgcactgatatcataaaggtgtaggtaaattggtggggccctggagtgcctcacgtggtggcttcaaggtgttgcatctacacagctgggacatgggcagtaccgttttctaaacagtgcaatttgttaggaggagaaactggcttatttctttgaaccacctgtgctacatccataagaggctgcgtttgaggttctgtttgggaggcagaaaaaagtctctagaaggcacctggaaataaggaagctaaaagtggagacagattggagctgaagacttaagttgtagaggcaccttgaaggaattgtggttaagcctcgaagatgggtaaggtggtcacaggagttggaggtctaggaaggaggggtaactgcagagaaatccatatttgggattagttttgttccttctcctaaagtctgtgtgcggcagcagggagtggtgaatacagtcaagatttgccacttgggactaagccacagtgtttccaaataaagactttaagaaaccctcctcactcataatgaatttaagggctaaaccttatcagtcacacacacagaacaatgaatctttccctgaggcaatgcaggataaagttttaaagttttttttttttctttttttaaccctgttctgttgaattatcttcaaaactgccttagattctgggaccagggtgcggagggacagatggggtgagtgattttgaatgctgcagctttatcttgctgcattataaatatgtgatgccatttaacatagcaagccatcaggttagtaaacaaatgattgccaagtttataattggcaaggaaggaggttataatctataaggagctttgtgtcccaaccaatttattctctaacggaactttattgcctccatcgctgaaaactcccgaagagtcttaagagctaagaatccagattggctgagctagttttctcttgtggtctcctttctggcctcatctcctatccggataaagatacttggaaaacccatttcttgaagatgaagcagcccacctggcccagaaatgcctggtttgttgtttatgggtggtttttatccagtgaattggcaagaagtgaattatgtggaagaatccattttaaaccctttcagctacacaaaattggaaaataaaatattgtgtttcttgagatcatgaaccaatactgtctgggtttcttagggtatgaagcccctttggggtcaaggctcagcctgctactattacagcctcataccctgcttctctcttcctagtatgatgattaagtcaaggatacgacgcaattgaccaggtgtgcagtgcccaactctgtggggccattaacttcacagcctacataaagaagccacttacggttttgtgagctcacactgctcagttgtacatgatggccctggtgacaatatgtgtttttggaattagattggcctgaggcaaattctacagaaaaatagagggaacttagataggttgctttatttgtaaaatagagggttataatacctttctaataatgttgtttacaaaaatgatgcaagaaattgcttctcttagtatgtatttcccctttgcctggattacttaccacaaagccatcgttgcttttcataaacaacttccgatcccttctgtggggtattttccatgaccttccctcttgctccctcatctttgctgtctctgaatataggtatctaactggaaggctggaagtgccatttcaaagcggtggaatttttttttcttcatttgttgttttattttgctttattgcattttccatatttttggctaaatctgttattacctgcccatttcagcaactaaaatctgtttgctttcttgtttacctgcatagaacttactcttccatcttcttggaatggaacttgtctcagaatctttcaggcgattgcctgagtccttcttacagacaggactaacactccccttggaccccaggtatctgcccatgactcagtcttgttcattcagcattttccattcctctggccttgatgtttggttcaccagtgggcatgtaacccaattctatccagttatacttgtgttgggaagggattttttttttccctggggttgtgaaagtaacaggatataagtttgggacagctgatggccgtgttgacattatgtgagtgtaataaactgaatgtttgtatccttccaaaatccatacatggaaatcctaactcccaatgtgatggtattaggaggtggggtctttggaaggccattatatcactagagtggagccctcacaaatgggattagtgcccttataagaagagacagaagagcttgctttctctcttttctctcaaccatgtgaggatacagtgagaaggctgccatgtgcaaaccaagagttcccttcccacacaccaatctgtcagtggattgatcctgggattcctagactctagaaccgtgagaaataaatgtgtgtttaagatgcacggtctatggtattgtgttacagcaactcgactaaaatggtggggaaagccagtgtgaatgcaaagcaaactgttaaaaaaaaaagatacccatttctgacattatttgagtgtcagacttgcatctaattgagccgcaagccttgaacttatcagctttgtgataaatctccccttttttgtgtataaggtagttcaagatgtattactcaactgtgcatcttcctacagagtcttttctactacagcataagaaacttgagagcagaatggtggatctgcatgacacgttttggcacttgttacgttaaactcaaaaactccaaacttggaggtttagaagcagagatttaacaaccaaaaattgtgcatagtcaacctgatgaattaagatagcctgtgagcctgagatgctgaagtcttttttttttttttacccagaaatacggtgattttttacatgtcacatcctggatcgactctctgtcagctcagcaagtgtcttcagagctgacaagtgataaaccagttgaaagtgccagtcacattgtttggttattgataatgctgctgtaccagggatgtgtcattagtatgtgtttacgggctgcaattctcaacatggacccagcagaaaatattgggtacttcaggcattcttgttatttacccagatggtgtttcgtgggataccccctgcctagagcagatctggatatgtgtctacactggttccaaggatcctatactgggataaagcttcagttccacatagtggtcagtggcttcacaaaataaattctgtaggtggccttctctcccctgcaccattttctaccaccaccaccgtcatcaccaccatcatcactggtgtttcatcccaaataaacaggtgcatttctttgtctaattttagagccagtggctacttcttacccatctggtgggtattttttacagaagacctgatcactgagttccttgcaaagatgtccccatcttttgcttccattgtctcatcagtagaaactcacaacatgaaataataacagcaattaatgtttatatattggtcttttccatatggtaggtatgttggcactattccacgtgctggggttggagtggtgaatggaacagacgtgcccttgtctttagtaaatacactacaacttgtatattttagtgggagagatagatgataaggaagtaactctagctgaaaaatataattacaagttttgaaaagtggtgtaaggaagtccacaaggtaatgcgagtaagagtaattgatgatggtgataggtgttcacggttggacagagtcttgagaacaattagttccaaagtgaaaccacctttaaggaggcagcattttcgtggagacctgacatggtttggatttgtgtccccgcccaaatctcatgttaagttgtaatccccaatattggaggaggagcctggtgggaggcaattcgatcatgggaacggacttcccccttgctgtttttgtgatagtgagtgaggtctcacaagatctggttgttgaaaagtgtgtaccactcactgaaggtaaccatagtaacagcaaaatcccaaatgagttaaactcacaactaggttgactccagtctccgcataaacacactggcagaagagatgtgcatgtttctttctttttttcttatctttttttttgttgttgttgcttgttttttgagacagagtcttgtactgttgcctaggctggagtgcagtggcatgatctcagcttgctgcagcttcaacctccggggctcaaacaatcctcccacctcagcttcccaagtagcttctgggactacaggtgtatttcaacgtgcctggctaaatttttatattttttgtacagatgagactttgccatgttgcccaggctggtcttgaactcctgggctcaagggatttacttgccttgatctcccaaagtggtgggattataggcatgagccatagtgcctggctgagatgtgtacatatttctatgcaaaaatgctattgacttcagtcttcactactttccttcatagtattcaatattaaatagtatttaaatagaaatactaggattcaatattcaacagaaaaaaagaggaaaaaatagcccacttagacaaagcaatcacatcaattaaactcagaaaagaccccagtgttaaaattatcagggaataaatttaaaataactattactaatagtttaaaagttttaaagcatagtttcctcatcttcaaaataacctgtttttttttttttgagacagagtcttgctctgtcacccaggatggggtgcagtggcatgatcttggctcactgttagctccacctcctgggttcatgccattcttctgcctcagcctctggagtagctgggactacaggtgcccatcaccacgcccggctaattttttttttttgtatttttagtagagatggggtttcaccatgttagctaggatggtcttgatctcctgaccttgtgatccacccaccttggcctcccaaagtgatgggattacaggcgtgagccaccgcacttggccaaaatgatggttttttaaagtgccaaattcttctggttattgtgcatattaaatgacataatggagcccgggcatggctgctcacacctgtaatctcagcactttgggaagcctgggcgggcggatcacctgaggtcaggagttcgagaccagcctggccatcatggtgaaaacccatctctactaaaaatacaagaaattagccgggggtgatggcaggcgtctataatcccagctacctgggaggctgaggcaggagaatcgcttgaacctgggaggcagaggttgcagtgagccaagatcatgccactgcactacaccctgggcgacagtgtgagactccatctgaaaagaataaaataaataaataaataaataacaaaatgttagtaaagtgcatgcttagcaaaatatctgacacagggtaaggatttagtaaatgacagtaattgtagtccttatcaccttggatacttaatgaaatactgctgaatgttcaagaaaaaaaaaagtgtgtacttcttcccccttcactctttttctcctgtttctgctacgtaagacatgccagcttcccttttgccttctgccctaattgaaagtttcctcagtcttcctagccatgctacctttacagactgcagaactgtgaaccatgtaaatctctttctttataaattacccactctcaggtagttctttatagcattgcaagaatggactcatacacgacctatgtgttcaagaggagccagccagggataattcaggaaagggtgttacaggcagcaggaacagcaaaggcagaggccctgagctggaaggagcatggtatgatggagaaacagaagtgagaggggtgctgctggagaatagttggggagaaagagacgtgtcgggagaatagttggtgagaaggagacatgtgtcaggaagagctagagagaccagggtggtgggtcagctgggacacacatgaatgattggaaacatgagcttcatttctgagtgtgccaccttttttattcttcaaataggtgataaagtaggtacttctgaaggattaaggatgttgctgaagtgtatcccacaagtgaatatcagaaccatgattcattccctctctttgcacaatccatccattttaccttaacatgatgctaccatgttattaattggttttgaagctccaggtacattaatactgggacagtattaattcctacttaacataaggatcatgagggctaagatgaggtcacgaatatgcagcttttatgctggtggtcaggcatagtctgttcacaataaacagtagaatattgcctcttctgatagctcagtgtttgctttatgtaaccattttaaaaaatgtaattgtggtaaagtacacgtaacataaaacatatcatgttggccgggcacggtggctcactcctataatcccagtactttggaaggccaaggcaggtggatcacctgaggtcaggattttgagaccagtctggccaacatggtaaaaccctgtctgtactaaaactacaaaaattagctgggcatggtggcgggtgcctgtaatcccaactacttgggaggccaaggcaagggaatcacttgaacccgggaggcggaggttacagtgagccgagatcatgccactgcactccagcctgggggacagagcgagactctgtctcaaaaacaacaacaacaaaaccgtgttaaccatttttaagtgtacagttctgtaatgttaaatgcattcatatttttgtataaccaatctgcagaactttttcatcttgtaagatggaagctttatgtttgttaaataacagctccccattctccttaccctccagctcctggcaaccaccattccactttccctctttgtgaattcctattctagctacctcatacatgagtagaatcacacagcgtttgtctttttgtgactgtcttatttaattcattaatgtatttgtttaattaattaattaattaattttttgacccaggcactggccctgcagctgcttccttttgggcgtggaaattcccactcatttcagggatcacgctcacacgcctattgcaggagtattagtaagcaccccccaccagcccacattatccccccaaaataacgagacctcacctggcctctgcatttccacatccctgctcaaagccaaatccattcctgctccctcgccctgtcctaaggttcatctgtattacagcatgtatcaaaatttccttcctatttaaggttaaatggtatttcctcctatgtatctactgatgaacgcttggattgctttcacctttgggctattatgaataatactggtataagcgcggttgcacagatatctctctgggaccctgctttccattcctgtggtacatacccaaaaatggaattaccagatcatgtgatatttctagttttaagttttgaaggaaccactatcctgttttccaagaggctaaaccgttttgcatttccacccacagtgcctaagagtttccacttctccacagcctcgccaacttttgttattttctgtttttgtttgcttgtttgttttggcggtagcctttctaacaggtgtgaggaggttgctctaagtcatcttggtcatgtccttaggaagtatattatttgcagagcagctggaaacatctcattctcttccatccactcctttctgatgaaagcggcatattccattgatggaatatttaccatgtagataaatacttggcattttgccaagtcattttgtatactcagtaccatgtttgtgtgatattaatgagaacctacagacttctttagaataatcaaggggtccttaagtttctgtcttgtgtacttgaaaatatccaactggaaaccatttaaatatggctaaaattctgtgtctctcttgcagttgcacaacccataattaaatgatttgtagaagcagtctgaattaagggccccgttcatcaatactacatgaattatgtaggcatatcttcatttttacattatttatctcagcggccagatgggtacattggctgcaatattcatcagtaagaaatccaaatgtagctttggcacactgacatctgtgcctggtctggccccccgtggggtagagtgaatatttgtggttggggactagggggccctctgcttctaggcaagtcaggagttctgcaagtgatggtatttgacactttatcagtcacctcctaagtagctcccatcagagataagtggaaaggatctgagagctacccaggctttggggaggggatgggcaatgtcccatgagtggtgatgtggacaccagagttttcacaacgtgtttgtcttggttgctgatgctctgtaaaactcagtagtagctaatatttaggaaggcagtgtaatatagtggataaaagtgtgggcattggggtttacattgtggctttcccactaatactgtgagactttgggcaagcagtttcttcgtgtttcttacctggacaatcatttaatataggcacctactgtatcagagtggtcgtgagaattcaccgagcataggcaggttataacattgagtatagcatgcaactgtggattaaaaagataaagacttaaagataccactatggagttatctcaaagatacattattggtgaacacacaaaagggcataatgttatgtattatagttttgatctgggtagaaaaaataatacaattatagattgtgtttgtatgtgcataacatttctggaaggttctaacacaagtcattggtttactttggagaagtggatggcagtaggggatatcttgagtgagccctgttgtatattgtgatctttgttttaattttacgatttgcatatattagtatttttgaggagcaaatagtctgattttgaaaacaaggaatgagttacagaaagctgcatctgtctcgtgaagattttttttttctttgcagttagacaggaacctggtgatgaggctcccctagacttctggagagtcttccagctacgtactcaagatcttagcttactgacctgtatgttctgcacgaggttctcaccattgtttccagctccacaccctggccagatacagagcactcacccagtcatgatccatcaggaaaataggaagttggaagtgggctccaccttggcccattgctgagggcaagtaggattttcacttaaccgtttgggagaagtggatatttgcctctactatggtctgaatatttgtgtaccctgaacatttatatgaaatatttataccccgggtgatagtattaggaggtgatgaggccatggtggcagggacttcatgaatgggattagtgccattataaaagaggctttacagacctccttgccttgttgtcctgatatgaggacggcgagaaggcatcttccattttttttttttttttttgagttggagtttcactcttgtcacccatgctggtgtgcagtggtgcaatctctgctgactgtaacctctgcctcctggcttcaagcagttctcttgcctcagcctccccagttggtgggattacaggtgcactccagcatgcccagcaaatttttatatttttagtagagacaggtttcaccatgttgccaggctggtctcgaactcctgacctcaggtgatccacccacctcgtcctcccaaagtgctgggattaaaggcattagccaccacacctggctgccatcttctgtggacgaggaagcaggccctcaccagacaccaaatctaccaggatcttgatcttggacttcccggcctccagaactataagaaaataaatttctgttatttagaagccacccagtctgtggaattttgttatagcagcccgaatagactaagactgcctcaaagtcaacatttaagagttcagattagaccatatagggtaacttttttttttaattttaatttttattctaagttctggggtacacttgcagaatgtgcaggtttgttacataagtaaatgtgtaccattgtgatttgcttcacctatcaacccatcacctaggtgtgcattagttatttttcctaatgctctgcctcccccaaagccatatagggtaacttcctgaccttgctgtagcatttgtaaactgtcatggcagtagtgggagtgtcttttggcatgcaaatgcattacaaatagtgtataatgagtaatggggacagccaggagtcacttttgttgccctcttggttttggctagctttttttttttttttcttttttttttgagacaaagtcttgctctgtcgcccttgctggagtgcagtggtgcgatctcggctcactgcaagctctgcgtcccgggttcacgccattctcctgcctcagcctcccgagtaactgggactgcaggcacccgccaccatgcccagctaatttttttgtatttttagtagggacagggtttcaccgtgttagccaggatggtctggatctcctgacctcgtgatccacccacctcggcctcccaaagtgctgggattacaggtttgagccaccgcgcccggccggttttggctagctttttaaggcatctttttaccaacgaggtctttgtgacctgtacctggtgccgaccatctgtcacatcctgtgactcacaatccccaacctaccgtgaatgcagcccagtgggtctcagccttaggggatgaaccctcagttttgggaattgcccacccctttcctggaaaactcacaaataatccaccccctgtttagcatataatcaagagataatcataaaaatatccaaccatcagctcttggggctgctatgcctatggagtagtcattctttattccttttaatttcttaatacatttgcttttacttaaaaagaagagttcagattagttcttctaaaactctatattcagggtagatttccatctgttttctttttctataaatgaaccaaaaatgttgaaaattctatcattttaagccattttctggcgccgtgtgtgctcttcaagcattgggttgtgcaatactgtttgcctttttccagcagtgtttctcatttgatttatcagagatgatacttggtaattcagtttgatattgtcccctgtatctgatgataaacacttgagggaaaccaggaaatctattttttatgttaaataataacactggccctttcattatcctttcagcattgcaaatcaccctttctgtctcggcaaagagagaggaattaagatttgttccgtgttgactcctacgtgattatgttattcagtgttaaatatgagagaactttgttacacagagccaggagggggcagtaaatttccttttttactgttattaaaaatggatcctgcgtttcatgcatagcaagatctcacccgtttgctctagaataccactaattcctaccccctaccccagcaagggaaatttttgaattcattgtgactctggttttatgtaacatttccattaggttttaagtagtgtgctttcaaattactacctgtaaagaggcaaaagcaaatttttgcatttgtaaaaaaataataaataaaaataaaacgctattttttctttttttttttttaactttgcaaaggagataaaatcacgacttgtcttaagatctgctttagctcttcccgttcccaagtaggtgaaggtggaactatcactagataaactgaaatcaaagtacagtgcctggacatgttcaggttcttgtgaacaatgagagaaggcaaggatgcctttaatgtacatagctgctttcctggtcatattctatcagttcagcaaacactatgatttcaaacaggtgtgcatgcccagagaactagcttgctgatcagcgtctggactggacccctgggcttgcctgtgcgttttctcttccttctgctgtggctgctgcttcctaaaacttgtgtctttgaatatcattaacttacgtaattgctatgttccctaccagggtacctaatatatctggctagttttaaggaacaccaagttctctctgtgggatgatttgggggtggcttgggaattattattggctgtgctataaatggctgaggagggaaataaaggacactttcaggacacaattaacactttctaatggcacagcctatgtgctacccagagactgggaggcagtgcagacccagagaaataatgacatacgatgagagcgcctcatgaccttcaggtatttggactgaacacacacacacacagacacagagagagacacacaaaacacacacagacacacataaatatatgtgtgtgtgtgtatatataaaacatgtatatatttgccttcaaaagtcgcaattccatagaaagaagaggtgagactcactatcctgcaattctgacaatccctcaacctgcagactggacatttctggtgacttctaaaaggtaataataggttaatgtaaaattaattgcgttttttgccatttctttcagtagaaaaaaaaacgcaattgcttttgcaccaacctaatagaaactatctaaagaatattttcttaagtatccaggttctcattagtcttcattttacaattgttcctggtttttttttctttttttccttcatattcccccgctgcttccacctacaccagatgaagcacagggcaaaaactggattatacgcaaattgtacactgatttattagcgtgagccaggagtttaatgaggggagagggaaccgtacaaacagctcttggggcctatgcttgagtggagttgtgccgccatactaggtttcagtatgaatttgggatagggtcttctaccccctccttccttaaggtagaaatgaggaatgtgtctacttacaaatgtccctggtacacctatcaaatgggctcacacgtgtgagtctctccatgaagtaccctgctgagttcagtagcatccgtccagtatttgttttgtcaggcatttgaggtctttaatgttttccaggacatttgactttgtttctctgttcctcctcgggcatgttagtggcattaacttacagtccagtatttacctgattccattttgaaatcatacagcctgttttggaaggctagttctactacgtacgcacagagatgaagggaagaaaattattttggtctctttaaattccctatctgtaaattgaagaaattgtagtatttccatcctcacaggtttgttttgagatctaagtaacataatgcagtcaggattttagcatagagctagccaccaagtgaacttcaataaatggttaatattttatcattagttttgacttttgttttcatatccattcattatgctttttggaaaattacttcaagcagtgtcacttcttacggtcattgtatcaccttaagtgaagcttctgcaggactgctatattgtggtatttatgcctttaagcagttttcagcttggggaaatacaaggttgcagtttacttatcaaatagtgaaaaacgtaacttgagcaaatttctctcctgtataaacagttaaatcccaatgtcttgtcgttgtttcttcttctagaagaggttattccttgagcccagttgtattttgtatgtttcataaccttggaaattgttcatctctatgaagtaatcccttttattacataatataaagggaagataaagtttttaattctcaacgcatctgaagtggtgacatgtagcaaacagctcattatcccccacaaaaagcacaattactcaatatagggaagcagtgctttcagaagctgcctcatattggagctgccccacgctggctaatgttggatattgattctgaataattcaaatagcaataaaattgggttttcatgacagtcaatcagaggcattttatatttaatgctcaatagaagaaacacggtgtctccttaccttctgaatttcaaagccattaaactaattgtaggtcattatgtgaaatttatctgcataattggaatagttgatctaattcatgtagcattcaaaacagtggccagagaagaactgatgaatttttagataatgatatatatatagtacatgtatacatatgcatacatacgcacacgtatatttgtatacatacacacacttttagtcaaagtagtgtcactttaccagcattcatttttgttaatacagtcaacaaatcatacggggataactttaaataattcatttgatcctgtttctcacatattcccagtggcctcagaagtgaatagcttctgttgaaatggagatactaaactaaggagttttgttctttatatgattttgctgatattttcttcttagttttcatctgtctttccaaaatagacttacctgggagatatatatgattatatgtatataattggggtcaccagaccccagggattctgatttaatttacttgagattgggacctgacgatcaagatttgtttagaagctcctcagttgattctactgtatagcatagagtgagaatcaaggtaaatctaattcagtcattcactcactcattaataaaatagtttatcaagtaccttttatcttctgcagtcttacaggcgttctgacggctaaaaggtgaggaagatagtattgtaggagccttcccagcaatccattaaaatgttttaaagtgccagtttagacatagaaacaaagaagatgtttatatacagctgcctggaaagcctaatacttctgtctctgggaatattatcaaaaccctagagggaaatgggcttctaaagggttcttggctgtgtgtagaaagtacctcattctcttctaactttagacttgcaacccttaatatatgacctcagattagtttgttggaaggtagagtgacatatgaaagcagaattccaccttacttgggagttgggtcttaaagtcacactctgtgttcacttaagttgagtttgtttctagcatgtgcaaagcagagatatttctcctggtaaatgctgaagtatcgtgggacaaatggagtttggaagaaagctgcttagaaacgagaatggcccaggagatacaacatgtaaaacttgtacaggatgcccgactccgagaagagataatggctgatcaaaaactcagatcctgatgccaacaaatgactatacttgttgaatatttttgtctaggaagtaatttggagagcttggaaataatcatggagataatcttgatgttctttatatattcccaggctgcctgttagaaagacatctctccaccttggcaattcctgcttcctttgacttaagtatttgcttccctaaaagaagccttaaataattataactctttacccataaggagaagaggaggggacataggaacaaagcctgagcaaatatatatggttcatatagggagatggtagaaccgtacaccagtgtacggccctaaggatgggggtagcaatggtgagaatcccttgaatctcattcttgcccaatttagaataagaaatacattatatagtaagcagtaagcatgtggaatctctctctctctgtctctatcatctgtgcatctgtcatctctctatctcatctatatctaatctatcaatttatcaaattatctaatctatccatctatctaattacctaactgtctaatctatctatccatctatctacctgtctacctaatctgtctatcaatctatgtatctatgcatctatgtatctgcctatctacagtcctgaaaaagggattggattcagagatgatagtgatatcattgtttaatgtgaagactggtcattttgtggaaaatcttcaatcatggtgaaataacacctcttagatgaaatgccactgtccaaacgatttttaaggtcactgctaggggcaaacagacaaaaccgattatttagtgggttaggaattctagagttggaagatggcttagatttcatttactaggagtttctcatatgtggctgaggagcagagccgcaaggggactgtactaaagattcccagaccccaccctgcttccttgaattagaattaccaaatatggggtggggagatttctatctttgacaggttccccagctagctccacaatgatcaagaaacagcagtgaggaaacactgcttttgttagtatcattgatgtcagagatcacaaaagagaggttatgtttgcaacccagatcagaagccagattataaattcctacctcaggaatatcctttacctttggaaaactggttatattcctcccttggaaagcctgaattagaagatgaatacagagggactgctgaggacagctagaattatctaagatgcaaaaatacagggaagatacatatcagatcctagaggaactaaatccagatactgaaggctaatgggaaatggtaagatgaggtgggaagtagagttctgcacaactaaaaaggacacaaaaatattgccagaagcacaggcagatactgaccatatatcattgtggatcgttgatgtctagggcacgactatactttagaaacaggggatcagtgacctcacatctcatcttttgtagcatactgctactctctgtccttcatcctgtgggtttgccatctttttgtgctcttgcagaattctagctgcgagtatctgtgtctcagttcttgagagtatttctcaggattatgggaagttgctttgcccatgcacaataggagaccagaattgtgaggcaattaatactccagggaatagcccttaactaatggctcttgggagctggagtgtaaacaccccagctccctcactccatgggtaggataatgctgaggcacacgttttgaaagttttcccacatgactaggctcattgtatatctggcttcttagtccatcctttattacaggatgcttttttcttccctgtgctaatttctccatttctcccttccccactgctgtttcctaccttccaaaatgaacaacgttttctaaaatccttggctcattgtctgcctctaggggaatccaaacaaacaaagtatctgggtcttcctatgttttcttgcacagccagttaaaatctgacatctaggagtaatgtatgaaattagctgagcctactaaaaccaaatttgaatcaaaagggaagattttttttaaaggatctaggtaaattctgggaactgtattggaatgacttaagctatggcttgagatctatccctcttttaacctttccttcatttctctttcagtcttccctttgcatctgattcttctgcatagtttctggtctctttcccctatacatctgatccctccatctttccaaagattgactttccctgcttactcacagttgctgcttctctgcagcctcagctggcatgtaactggattacagtggtgttagatgtggccaagaatccacagtgaaattccagctccagaattcaccgtctcggccccaggctcctgttcagattctcacgagagagtgagtctctgacagatgcagcattccttgctgggaatcagcttccccaaggcaggtgacctctctggcccaagcacctgcactgcacctgcactggggagtttattgaggatggtgaggtcacctgattcattgagtatctcttccagggggatgggcttaggatcgtaatctagaaaacatttagtgtagcaggcaattgcttttcatcctgaataggcagactttccaccacgattaatgcacgtagtaggtctgcaaggcagggaccctctgtgttaatgtaaggacagtgacattggagagaagagcaaggtgaatgcttagcatttacatagtatgttgacgtcctctgttgcctaaagcacataagcctgatttatgccatgggagaactagcacattctgccagtgcctctgtacatgctgcacacctacatttttgaagagtaaataatgaggtggagtttttttgttcatgtttttgttttaccttggacagccattatgtaaacttttcacaacaaatttgcatctgaaagtttgttgatccttgtgttatatttcatgacaaatgatgaaaatgctaatttctgaataaagtaagagctacttttacacatttatttgcagaaggaattataatttctttattggcattttttaaaggttaggtacatagtctttttaaaaattaacttattaagagacgtcaacatctagggctccctcttacataaaaagatgctgaaaacagaaatatatgaatataagcactgttgaatgcaaatatcaaaatgtgaataatgagaacagccaacccctcatctcccataggtcattagaaagtgcttcttcactatttatttattagcaggtgccagagccctggcaaactcccttttttgaaatttggccttcagtgtgatagaaacaaatatgacttgggatgatagaaacagaaatatgacttgggcatatatgtagtccttccatccttccataatccagatatgctgaactgatctgtacacccatgtgtcagagcaaagcctgtgcctgtcagctgaacccactcagtcctacagccttcctgaaaattaaattaaaaaaggttttttggtggcttttataagggcaatagcagaatttgctaggtcaagctagtcaacatttttataatgaaccatttaataattaatatgtagcaaatataaataatggttgtagcctgcagtagttaaaaacctgagatccttacaggaagtagccaggggtggtggtgtgcacctgtagtcccagctactcaggaggctgagatgggcaggtcgcatgagcccagaaggttgaggctgcagtgaactgagatcacaccactgcactccagcccgggcgaaagagcgagaccctgccttaaaaaaaaattctgacctctgaaatctgacaaagctgggttctactaccatctctgtgacttgctgctggaaagcaggagctcactccagagctgacgttcacccagaacgcagggccagtgttggttctgattgtcagcgctatgctgtacagggtttcagttcttagatagtctgaatagcatcgttgtctatctttaagggttgccataaagacaaagtttataggacacagtgttcagtccctgccacatcattacagtttaacacgtgcttatgtttcttgccatggtcattttagagaacttataccccactgcctgggtatgaaattccagtcttattaccagaattgcacagggatccgccagaattatacagggttcaacaggtttatttgacgttttttgtgcttttgatttcagcccacatccgtgcagctctgcaattgtatgatgtctgacccctctgtccaactcccattgaatatctatgaatgccctttgttaagcagtgtgcatgcgagggctggtatagagatatttgctttgttcagaaggcaaaaagactatcctctgggctcagttttgaattcacaagattgctaatcattgatcgtaacagctctaatttactgaacactgacaattatgtagccatttcctttacgtggattatctcatttaatcctcatgataaaggtcatggtattgcctcattacagatgaggacatgggtccaggaagttaaaccacttacttgaattctcccaaagtacaaatggcccaactaggagttcagtccatgtaattaagactgtgctcttaactactctcctaaactcagtgggactaggtctctattcctcagacattcttttctttgtgatagtttctcctctcattctacacatattttatcttatttgtgagggaagagtcagaaagcagcactagacttcagttcctctctcctttcttttcctccttttacccctatccaatcaggacaatataagttgtacttaagatttgtggaaaatattttttacgaaatctagatgcataaagcaaaacaggtgcagcaatgaaaagatgagtcattttcaatagttcttgacgcctagtaaaggttatcagaatgtattaggttgtgttgcctcgcttgagcccaggagtttaagactggcatgggcaacacagtgagactgtgtttctataatttttttttaaagtagcctgttgtggtagcacagtgtatgtctgtgttctcagctacttggaagactgaggtggagggatcacttgagccagggaagtcaaggcttcagcgagccatgattaaacaactgtatacactccagcctgggcagcagagtgagaccctgtctcaacaaaaacaacaacaacatcaacaacaacaacatcaacaacgaaaaccaaactggtggcttattgctagatgcacatgatttaatagaaagggtatggtttgggagttaagtacacttgcctcctacccaactcagccactcaccagtgggttcatgttggtggaattacttaaactctaaacctggttacttagtgccgtcagctagggagcttgtacctactattcagggctttacttttaaggattggaaaattgtaaataggtaaatggatagatatttttctgtcttagtctctgcagtgcctgtcggagactaaatcttcagagtatacatatttcaacagttatttatttggagacgtttgagtggcagctactgttgtgtcttttaactatttctcgtccccatggatgtgacttgtatttgcttatgtcccattgcatggctaaaataacttgaaacagaagttgtgtaacattggatcgatcacaaaatgtttgggtaacaatgctgagactctctcagatccctagggttgcatttcccctagaaactgaatttggttatgaaaagccccagtgcaggagtctaccatgatagttcccaagtggcatgggtggtgatctgtggttcctctccccctgtgaagaacacagacatgaggaaatgaatccttgaggcggagcattggttacataattcacaggccctccttctgagacctctggaaataagcagatggttgaagaatgagggagtttttgtcgccattttttttttgccttttgctttaatttttggaataaataaggtttgcttccctactgggcctgctcaagggtaattaacttcttctttttgaaagggatttagaattttcagcatggttaccccaatatttttctgatctatccagtattacacaatttttgttcaaattattttagccatccaaggagacataaatacaatttatgtccatgttgttaccatggaaaaccagtttattttattttattaattttttaaattttatttttccataagttattggggtacagttggtatttgcatacacgagtaagttctttagtggtgatttgtgagattttggtgcacccatcactgcatcatattgtcttttatccctcacccctctactcttccccccaagtccccaaagtccattgtatcattcttatgcctttgcattctcatagcttagctcccacatatcagtgagaaaatatcatgtttggttttccattcctgagttacatcacttagagtaatagtctctaatctcatccatgtcattgcaaatgctgttaattcattcgtttttatggctaagtagtattgcatcatatatatacatacctcaatttctttattcactcattgagtaatgggcatttggattggttccacgattttgcagttgtgaattgtgccactataaacatgcatgtgcaagtatctttttcaaataatgacatcttttcatctgggtagatacccagtagtgggattgctggatcaaatggtagttctacttttagttccttaatgaatctccacactgggaaaaccagtttagaaggacaggttgtgatttgtagcaggtggtggttctgaccatgtatggaatgctgtattcatacatctgaattccagatgtggataccctggaaagtgggatacctagagtctgaagcaattgatttggagcctaggtatagacttagcagggaggagtgctgtgatggattggtgatgtctgctgtgaagttagcatcgggaagcgacagcctgtgtgccctgtattcgccacttatccctgacacgggaaccgtctgaaaagaggagcctcatttaagcagtattcagtgaacatctaccatgtgtcagatacttcagtgggcagtgaaaaatcagttctgagtaagatagtccctgccttcattgggtttacaatagaggaaacaacagaggcaaagctgtaaagaatattggcaagaatggtagatatttggctataggtcaagcaaaaaataactcaatgtaatttaaataaagggttatgatatttttgcatttccccgtatttcttctgacaaaagttcacttgtgattatccctacccttatatgttatttatagatttcttgtttagaagtataaaaatgcatcagttttatctgttgtttaattatcaggtaaagactagaagaaatattgggccttcatgtaagtgtgcatcacagtattaaaatagaattcaaatatttgaaagttaaaaagaacagacatgttactccttgtccagttcagatggccaaaacagctactacgtggtggctatgaactttctggaagtcattgctgctcaacatcagttttaaatctggactctgcttctaggatgtgttttctcgcccgaggctcatttgatgtgagggcttagcaaataaatacagttgggaagagtgaagagtgttaatcaggttcaatataggctaggctttttcctcaaaatgtcccagagccttaggttggatgaatgtctaggtacacaaatgatatatgggatttaaataatagtccatttattaataagaggaaaggtatcttatatcaagattgtttatatttcatttagttaactccttttatttgggacattgcagacttttcctaaacaaaatgtactataatattttcgagatgggggaagccatgaagcctaagttacatttaaaaatttgttaaataagataatgagtaaacattcccagcacaatgcttgagccagagaaaagtgctaaataaattctaactattgccactgggaataataatgtgtgtctgcaacagaaaacaaaaacacaaaggacttgtctcttttttttttgcggtaattcttaaaaaaaaaaaaaagtcaggcattttcctcttgtcaagatggtgtaatagggaccagatgtaacctctcatcttaaatgactgtatgatgatcaaaacacatggaacaatggtttgcataacactgtacatcaaatagtaatggacagcaatccttgacaggagcaaaggatgtgagtcctttgattgccccagcttactgctttaagagtttccataaggagaggaggggaactgagatgaagcctggagtactccctgtattgaggaagtggaactgagggtccggggagcaaggcacctgtcattctgagtatagagcatcagagtggagagtaggagcccaggagagtatttataggaattctgaatgtgtatgtatcgaataaaagagctgtaaaatctgtgaagcaaaaacatgtagaacataaaaaaacagatatatgaacccacagttataattgtaaacctcaacatccatctcgcaacaatttatagaatgactgtataggacataaggaaggatagagaagaactcaccaccatcaaccaacaagatgtcattgacaattacagaaccctttaccccaaaagagcagaatacacattcttttaaggagcccatagagcatataccttgagagaccatgtcctaggccataaaatagacatcagcaaatgtaaagacagtgaaatcttggggtgtggtctctgacaacagtagaatcaaactagaaattaattcataaagagaacaggaaaaaatcccaaacacttggaagctaaacagtaaacttctcagtaatccatgagttgaaaatgaagtctcataatacattttaaaaatgacattgaacttaatgaaaataaacatacagtgtatcaaaatgtgtgtgtcgcagccaaagcagtcattagagggaaatgtatacccctaaatgctttcaatttaaaaatgacaattctaaaatcaataatgtaagctcctacttcagacaaaaatagggaaagaagagctaaataaacctaaagcaagcagcagagaggaaataataaaaattggagcaaaagtcaatgaaattgaaaacagaaaaacaagagagaaatgctagttctttaaaaatatagaagaaaatggcaaacttctagtagggatgatagaaaaaaaaaaagaagggaataattacccatatcaggagagaaggtgagaatattactatagaccctgcagacattaaaaggataataagagagtactctgaacagctctgcacttactcatttgagagcttaaaccaattctcttgaaaagcacaaactgcaattcacccaatatgcaatagataatttgaatgaccctataactattaaggaaattgaattcataatttaacatcccccctccccccaccccaagggaatctccggtctaaatggtttcactggagaattctacccatatttttaaaacatttaacaccaattcttcaaaatatcttctagaaaatagaaggtgggccaggtggggtggctcatgcctgtaatcccagcactttgggaggccgaggtgggtggatcacatgaggtcacgagttcgagaccagcttggccaacatggtgaaaccccatctctactaaaaatacaaaaattagctgggcgtggtggcaggtgcctgtagtctcggctcctcgggaggctgaggcaggagaattgcttgaacctgggaggcagaggttgcagtgagccaagattgcaccacttcactccagcctgggtgacagagcaagactctgtcttaagaataaaacgtggtggtccacattccactttattttatgaagccattacactctggtcacaaaactggacaaagaaagtaacaaaagaaacaagaaaactgcaaatcaatatccctgataaatatagaattaacactatttaaaacattttcaaatagaatctaacaatatataaaaagacttatgcaccccaacctaatgaggaatagtccagtaatacaatactaattcagtatttgaaaatcaattgatgttattcactataccgataggttcaagaagaaaaatcacatgctcacattagctgatgcaggaaaacatttgacaaaattgatacacaaccagaagtctcagaaaaaaataagaatcgataacagttttcttaactcgataaaggatatgtgcaaaaaacctacatctaatattgtgtataatggtacaaatgaatgatttccccttaaatacaggaacaagacaccactgctattcaacatagtagggaatttctaaacagtgcaataagacaagaaatataaataaaaggcatacagattaaaataaagaaataaaactatccttattagtggattccatggttatagagtaaacaccaaaaatttaaaacccacacacattttgtggactgacaagttagctcaccaaagtcacaggatatgaaatcacattgccaaaaacagtttctaaatttcttacagtaaacagataaaagcaacttaaaatacaatacaattttaatcacccagaaaaaagggaaatatttaggtgtgcatctaacaggacttgtatgctgaaaattatcaaatgctgatgaaaaaggccaacatgtaaatagatggaaaagcacagtgtgttcatggattgaaagactccactttgtaaagatgccatttctgctcaaattgatacacagaggtaatgcaatcatttcaaaatatcagcagagtttttaaaaataaatatagacaagattatctcaaaatttgaatagaaaagcaaagaaactagagttgttaacacaattttgaaaaataagaatcaggtgggacaaaccagtctacctagtttcaagacgttatgtaactccagtcatcatcgctatgtggtatttgcttagatgtagacacctaaatcaatggaagggaagagaagacactgaaatagccccagacaacattgaccagctgatttttgccagtaatgcaaaagcaatttaatgggggaagtataatctttacaacaatggtgctggaacaattggctatttataggcaaaataataataataaataataaatcttgacctaaacttcacatctcataaaaattagctcaaaatggatcgtaggttaaattgaaaacataaaactataaaactttcaggcaatcctataggaaaaatatctttcgaacttagagctcggtgacatgccaccaagggtctataaaagaaaaaaatgataaattagacttcatcaaaatttggctggacggggtggctcatgcctgtaataccagcactttgggaggctgatagcaggtggataacctgaggtcaggagttcgagaccagcctggctaacatggcgaaaccctgtctgtattaaaagtacaaattttagccaggctaactttggtggtgcgcacctgtaatcccagctacttgggaggctgaggtaggagaatcgcttgaactgcggaggtggaggttgcggtgagccgagatcatgccactgcactccagcctgggcgacagagccagactcagtctcaaaaaaaaaaaaaaaattaaggatgtggtctctgaacaatcctgttaagatattggaaagaaaagctataatgtggaagaaaatacttgcaaatttcatatctaataaagaattaatatctataaatttatgaagaagtgaaatggtggttaccagaaactggaagggtaaagggttagagaaatgtttgtcaaagcatacaaagttttagttagataggaggaataagctcaatagatcaattgtacaacatagtgatagactgtagttaataattctgtattatattcttgaaaatcattaacagagtagatttcaaatgttttcaccacaaaaattataagtgtgtgtggttctgcatatgttcattaacttgagttagccattctacagtgtatacatttttcaaaacatcatgttgtacgtgataaatatatacagttattattgtcaattttaaaatgtcaaagagtgaaaaccaatccatttagaaaatctttttaaagtgacttgaagaaatattttaccaaagaggatatatggaggcaatcaagaacatggaaagaattcggcattactagctattagggaaatgcagattaagaatataataacatatcattatacacatgttaaacaggtaaaatttaagatagaaactatcaaatatttacaaggacgcatagaaagtgtgtctctcatatactgatgatggcaatgcaaaatgacacaactcttctggcaaattgtttgtagtttcttaaaataaatagacatttaccaatgagtcaacaatcacatttctggacatttattccacagaaatgaaagttaatgtccacgaaaaaccccagaaagctatacacaattattgtcagcagttttatttctgagtcaaaaactggaaacaaccaaaatatctacagtaggtgaatggttaaagaaactgtgagatacccgtactgtgaactactattcagcaataaaaactgaatgaactatcgatatacacaacacctgtgatgaatctcaagggcacaatgttgaatgaaaattaaaacagtctcaaaaggttatagactatacaatgtcatttatataacactttgaccatgagagaagtataaagatttggacatagttgccagtatggtgggagaaaaaaagatgggtagaactataaaggtacagcatgaaggagaaatctgtggtgaattagttctgtattgtattgtggtggtagttacagaaatctatacgtgtaataaaaggggttaaacttatacaaacacactttatcaatgtcaatatcatatagtacaatatgatattatagttgcataagatgtaacaaatgggttaccaatgtcactagcaggatagggaaacaatacttctctgtagtgtctttacaactgtctgtgtatttgtaatattttcaaaataagttataaagatttgccttttatagtgttactgtaaacccttaagttcccactaaaaagatgaaatgtagagttatagctaataagccagcaaaggaaatagaataataaaaattttcaattattgtgaaacaagacacaaaaaagaggaaaagggaaagttgggacaaatgaaaaaccaataggttataggtttaaacctaattctgtcaatcacattaaatattaatgttctaaatatactcagttcaaaggcagagattgtcagacttaataaaaataagatcaaattataggctgtgttataagaagcacattttaaatataaagacacaaatatgttgataaggatgaatggtagtgcacacctgtagtcccagcactttgggaggccaaggcaggaggatgccttgagcccaggagtttgagaccaacctgagcaacatgacaagaccccaactgtacaaaaaatttaaaaattgaagtgagcatggtggtgcatgtctgtagtcccagctacgtgggaggctgaggtgtcagtatcacttgagcctgggaggctgaggctgcactgggctgtcatcacaccactgtattccagcctgcactccactgcactcagggcaaagcaacaccctgtctcaaaaggaaagaaggaagaaaaataaataaataaataaatgttcattattttttctcatgtgttttgactatttaaaaaatcatgttcatttatttctgattatttgtaacacattttcctatacattaattaaggatattaaccattcatctatgatatatacagtaaatgattttccagtttttcatttgtggtttaattttgtcaatgttatcttttcaatatataaagcaagtggtgtgttcgcatgtttaaataaagtgtatttctttcctttaaaaagtaataaagatacagaatgtgatcactaatctaaagaatactgaagtaactatactgatatcacacaaatagattctagagaaaaatacatcagggataaagaaggtaatttcacaatggaaaaggtgacttaatcaagaagacattaaatatttatgcacctcaactttaaaatacatgaaacaaaactgttggaactggaaggagaaatagccaaatatttcagtgctagtctctcaataactgacagaataaatagctagaaaattattaaatatatagatttgaatagtagtattaattaatttgccttaattaatgactgtagaaccctctatcctaaaatagcaggatacatattgttttcaagtacataaggaaatgttttcaagaaaagagctattctgggctgaactattttttttaatcaataaatttaagagaattgaagttatttctccaatcgcagtggaatcaaactagaaataaatgacagaaatataaaatgaaaatctccaaacacttggagaataagccacactttaataaataacctgtggatcgaagagaaaatctaaatggaagtcaaaataaacagtgacctgaacaaaaatatacataagacatatcagattttgcgtagtgttattaaacaatgcttgaagagaaattcatagcattaaatacccatattaggatagtgaaaaatggtcttaaatcacttactttatcttctgccttagaaaaatagaaaaagaaggtgaactaaattaagtagaagataggaaataaagatcagggttgaaatcaataaaacaggtagtaggccaaaaatggaggaaatctttgaaaccaaaagctggtgttttgagaaaattagtaaaatcaatacacttttagccaggcttagtaaagttaaggagaagatacaaattaccaatatcagtatagaaagaggaggcatcactacagactctataggtattaaaagaaaaataagatcatattatgaacaaccttattttatgatattaagatttaagggtgaaatgggtaaattccttgaaagagatctaagaaagctcactaaagaagaaatagatcatctgaatttcctgatatatatcaaataaattaaatctggagttgaaaatcttccctctaagaaaattccaagcccagatgactttgttaataaactttacaaaacatttctttcagaaaatggaaaaggaagttacatttcccaatccattctatgaggcaacgattactgtaataccaaaaccaggaaaaaattcacaagaaaaaacccccgaaaccacagactagtcttcctcatgaatacctatgtgaaaattctaaaacaacaagcaaatgaaatctattgacacatgaaaaggatactatatcaagaatgagcagattttgttttaggattgaaaagatgccttaacatttgaaaatcaatttatgaaatacaccatattaacaacaaaatgtgaactaacacaattattttaatagatgcagaaaaggcatttgacaaaatccaaaatggattctagttttttaaaaagctcagcaagaatagaagataaattggtcaatatgataaaaggcatctatggaaaatgtatagctaatatcatgcttaatgaggaaatactggtgttgcccccaagattgggaacaaagcaaggatttatgctttcaccacttccctttcgcagtattttagccagtgataatgagcaagaaaaggaggtaaaaggcatctgtttagagaagaaaaaaactgtctttattcataggcagcgtgatcatctgtgcataaaattttatgctctctaaaacagaaagtcactggaacttagaaatgaatttatcaagttgcaggatgcagtatcaatatatgtaattcaattatatttttatatattacacaaattggaaattaaagcttaaaaatatcatttgcaatagcattttgaacagtgaaatacttagaggaacaaatctgatggaagatatgccagtcctatacccttaaaactacagaatagctgagaggagttgaaagagacttaaatatgtgagcatacaggccaatatcgtgtgtaggttgagagacttatcttagtctcccctaattgatctgtagattcaacacaatgccaatcaaaccccagcaggcctttttttcaataaaaactcccaaacatattctaaaattcatatagaagtggaagtcaacttgaatggccaaaatatctttgaaaaaaacaatttgggaagatgaatactgtatgatttgcagacttaatggaaagctacaataatcaagaaagtggtgcgctgggcatggtggctcacacctgtaatctcagcactatgggaagactagacagttggatcacttgagcccaggtgttcaagaccagtctatgcaacatggcaaagcctcatctcaacaaaaaatacaaaaaattgccgggcatgatggcacatgtctgcagtccctagctacctgggaggctgaactggggggatcacctgaacctgggaagttgaggctgcagtgacctgtgattgtgccactgcacttcagcctgagtgacgagtgagacacaggtgtcagggaaaaaaaaaaagtgttgtcttattaatccttaactattattaattaattgaaagtttacatagggcagaaaagtgaaatattgatacatataatcaatacttatatatttataagccaaagtttgctagtgatcccaagtctgttataggaatgtgagattttattaagcataacaactcaaatgttgatgtccagttcatagaaactccatctcctagcagtcttctcagtattttgggagacttcagcaggtgtctcacttgggctcaaactaaaatctcatctctcctgtggagctatactactgtgcagatatcccctcaccacagattattgaggtgttagcctacagaagtcctagcagacctctgcagaacccctcacggtaccatagcaggtccctataccatgccaaatgggagatccttaaattatcttactggtcggccaggcgcagtggctcacgcctataatcccaacactttgggagactgagacggtcagatcacaaggtcaggagttcgagaccagcctgactcacatggtgaaaaccccgtctctactaaaaatatacaaattagcctggcatggtggtgtgtttgaaatcccagctactcaagaggctgaggcaggacaattgcttgaacctaggaggtagagattgtagtgagccaagatggccccattgccctccagactgggcgacagagtgagactcagtctcaaaaagaaaaaaaaaatctatcagtcagtcagtcagttagtctgtctgtctgtctgtctgtctgtctgtttatctatctgtctatctgtcttactggtttacttgttgtcacctgggatatgtaagaagcctgttggggcagtattcacataatctctgttaaaagtgatatttttagtatcttctatgggtcttctctttaaacatctcagatattgtctcttgtataaaaagtaaaagttgctatcccacaccacccctactatgtccttctgattgctgccttttttgcaaaagcagaaatatgtcttctgggcaccatccgcttcatggacagcaacttgtgcaaagagattcctgggagttgtcaatctacatgctcatagatgtctgaattgtgacatatcctcagtccctacccgccatccagagtcatttttctgacataaaactttcataggcaatccataccttatggcttcaccattgtaaaactggtggaaagcacaacacgctatcaacttcagcatcatgaggattggcctttgttttctaaatcctttctcttttgaaatgcacctattatacaagacttaggttgtatgatttgaaggattgttcaccagtagtgacaccgttatttattgaaccattttcctgatactttttttgtgttaactgaacttgtatatgtaattattatctggtaggatcattttttttcctagcgttatttatggcatgatttactagcatctcgttaggcaataaatgcatatttaattggatatccttatgggttcagtaccatgctgtgcataaattccagaagtatacagacccagccttcttttctctttctctctctctctctctacacacacacacgcaaatacatacacacacatatatacgtacacatacacatataactatatacatatgtatgtatgtatgagcacaaattatttggggtgggcactgtggctcacacctataatcccaacactttggaaggccgaggcaggaggattgcataagcccaggagttcaagaccagcctgggcaacataacaagatcccgtctctccaaaaaataaagataaaaaattagctggccatgatggcatgcatttgtagtcccagcttgggaggctgaagtggatctcttgagcccagaagttcgaggctgttgtgagttataattacaccactgcactccagcctgagcaacaaggcaagatcctgtctcaaacaaaacacctaattatttggagtatatagaatttgaacttgttatgcatgtatgaacagaagttatttggagtatatagattttgaagttggcttagatgtatgatgaattctcagaggttatgattaattatctttacctttcattctataagattttattgaataccttctagatgctagaatttcagcaatgagcaagactgataaggtctttgtctaaggaagaacatagaccccataaaattagtgttacagttctttcagaatttgtctagcaacctttctggtttttgctagaaagttctctcctaattgataaaataaaaatatttttgaaagggaagaattaaaaatcatgggattaaatgacaggaggagccaatctgggtattcataaaatgactgatatttctgtccacagttgagtgaaaagtattggaaaccaacattcactgagcaactactaggaaggccggatggcattcgagagaaaaagttatggtctcaggcagatctgagtttggatcctgctctgctgtgcattccaggcaagatcgtgttttggcaagttgtctgtcccatctgagcctgggttcctcattggtacagaaagtcagtaatgacatcaacccaattaaatgagagaacagatgcacacaggacgcattccacacagcgcctggttcaaagtaagtgctcaggacatgagtgccaccatccttcccccaaggaggcatgagatggaccctggttcttgctgttacggtcactcaggcaatttatactcataaccgtccggggaggtaggactcatgttttccccactttccagataaggatactgaggttctggggatttgaactaacctgcctttgacttcatatccagcaggcagccatgccgatttcaaagctccttctcttttcattcattgcaccgtttattgacctcatatacattcttcatctcctggagtgtctctcctaatcagtacatcaggggtaacaaatcttagtgacctcagtaaataataagcccaaagaattgcagtgcacagattcttgcttaagaataacagcgacttggaaagtttttcagtgttaacagagcagccttatgattaaaatcactgaagaatgcgatgtaaaatgtttttatttcgttttgctttctgtttcccttgaaataatagtcagcaggaaacacatttctgaaagacttctccatttctacatcctcagaatacaataagggccaagctgactgtgtcagggtgttcagagttagtaggcacacaaatgaaaagatggtgctctcagagttttatgaatttttctgtctagcagtcttgggttggaaagtcatctttgaaattgatgtagctatcaactaggggctaacattaagatttcagtcgaggtgtatagggttatgatctttctgttactgtcagaactgcagctgttgtatttgcattgagtggcatgctggagagagcaaaatgggatgcaggagaaggaaaaagaaatagcaaaacctattgaattgtgggctctacctgagggcatttgttaaaggtaaattcatcaatagctgttaagtcatttgtattgaatcattctcatagcctcacagcagttcttagttttaataatgggtcatagagaggagcttggtgatagatgccttattatggtatttaggcacttaattgcaactgggcttaaaatagcagcagaagctgaaaccagggtggctcaggagtaaattatgttttcagtctaccaaaacaccctttttaaaattcaagtttaatatttcttgacatatgtttcttgatacgctgttaacagcagtttatcagagatagaagaatgttaaaataaactggtgaccgaactatggtatctaaaggcatgccttgttcatcaccatcagagatattttgaaagaaacattgagacccaagtttaaaacacctgcaattatgctgggacaggggtgttcattgattcattcattcatgcattcattcattattcgtcatttattgctaatgttaaagggatagggcagtgtatgagacagacccttgcctttgtggactaattattcagtggtggaagtgagaaaaacataaatagttaataacaataaacgccaaagggggatgtgtgtgatgatgaaaccaggaagctgaaatagtgagtgatggtagaagatacagtagtgttttcttcagattagtgggctagggaagtgctcttggagaagaacccatttaagcagaggtctgagtgatatgaaggtgccaactggccaaaaagaggaaggatcattagaaacagaaacagcatgttcaagggccctgatgtgggaaagaactaaaaggagatcagggtggcaaagcttagcagagaagtcagtggaggggtaggacataggtttgaatagcagataaaggccaggtcctgtgtggccttttcatttactttacattttattcgaaatacaatgggaaacaatgaagagttttaaggacaagggtattgagctctgatgtatattattaggagattgtttttattgactctagaatggatggggagtaggtggctaaggaggaagttggcagtggtacgggagagaaatgacagtgccctctaccagaaaaatgaatggactgaaaatgtacttagaatgcatgctagtagataaagaggaactagctaggaagttccctaaaggagggtggtctgtattcttggggcatttgtaccctgatgactgaacatcctgacttcctatgtcttagtccatgtacagcaactctttgcctcacttgtaggtgaaatgattttggagtcactagttggataaagaactagaaaggtagaacatacagtgcttcctctgcacatctgatttgggagttttgaagtttacttgtcttagactgcatgaaatgtcaaaggaagccagtaacattgatttatttcttgagtccgttggttatcatcagcttgctgcttacagtatacaagcagatagagccagaagcggcatttccaggaattgaacctgcgttgtttactgcccctgtggtcttatgaagaatgtgtgattatcgtaacccacttgctattattttcataacaaagctgtctctgaccagctacaatcttggacttacataattgaattttagatggagatgcgctgctggtttatatgaattttccaggggtgccagcgtgagtccaggctttaacaaacaatatttttaattgagattttatgtccttgccctcaaatcaagcactttaataggatcccagttggaataggtgactcagtaacaagttaccactgctttcaacttcagaaaggtgttaatttctctaactcctgctgggcgtccatctactccggtgacccactgcctgcatgtaccataaaaacgagtgttttgcattccattagtttcaaagtacagccttagtagtctgcatatttcttgtagcatgtgctggctttgttccatcaggcaacattaagatagaaaagtattaaaaatattgatttgtcatttataacatcgaagtgatagattgaaatgcaatttggatgtactccagacctccaataactttgacattatcagacgaaatacaatgatctcagtctaattaatatgctgtgtccatatgagtaaagtagagagaatgaagcaagaaattggccacaaggaagtgatagctccatgtttcaagtagttgtagaatttagagatggaatatgacatgctctgtcgctggaccttgctatgtgctggaagctgtgttctttccatgtttgttcatctttgaaagcaagttagcgcattcctaaagaatagagtgatactcttcactgaactttgtaaacttctttaagctttttattatggcatcttgccataatgttcttccattcccctgctctggaataccggtaataactctaacacacacacctttctgcgtatcggtttcatgcaacaggtgcacctatcttgatttcaaaactttcctatccccctttcccttactgcttcttcacttccatcctttcctgctggtaatgaaattgtcaaactttattcctactcctatttttttttttttagcagggttctgtgttctctgtcagcctctctgctcacatattgcagttcctctgttctcccagagaatttttatcttcctgttggcaatatgtttatacggtgtgaatatgtaataattgtacttggttgctatggagaagggaaaaatacaaatgtgcaaatttcaaatacacaattgtgcaaatttcaaaatttattgtaactttttcatagtggtcatatagtattattaggaagtaatggcataaaaaaatacaaatattgaacttgagtaaacatcatgtatactgaaacttgtagggggtattttaatgatgtgtgaaatttactttgaaatgcaccaaaaataagatgggttgatggttgcagagagggatggacagatggaaatagctgggataaagcaagtatagtaaaatgccagtagtagaatataggtggtagatatatggatgtttgctgtaaaattctttcagctttgctgttttgagatttgcatactgcagtattggaaaaatatggtacaaaagtgaatagtcatatagtcaacacatagactgagataaaaattgtgtgcctgcattaatatctattcttttatttagggatgctttcaggaccgtagttgcaggaagatcatcttgctataacccagtgtccccctttcatctcctataccatgtctctctgcctgttttcttcttctctttgaatatttgttacatctgtcttaatagagactgtgcaatttcatctcttcatcaactcctgtaagtagaaccagcaacagagcgaaagggagaaaaagaaacgtacttctcgcctgccttccttttctgtctccccgtgagaagcctcgtgccctcctcctgtcttgtgtcttgtgtcagagttagcggagcagcagctctggcctccttggatttatgtgattcgtagtgagagaatgctgccacagctgaggctgttgcctgctctacattgattgagtttcctgggcttgagggatttttgccgagctgagttttatggttgatgtgctctcggtcatttgtcataaaatcattcccaccaagctgtttactgggtttgaatgcttaattactgaaggagaagagaatcactccttatggagctgactgttgacttggatgctttttactgggttgtcttctggtacccaactcttgctgagtagtttatccaatatacatacccactcttcagcataaaaaaataaagacacccataattttacctaagtattttgagcagtgcaaagacatatcatttcacttcatattatgacagcatttttcttttgagtacaaattgattgcaaaactcaacactcaggcagctacagctaggaaagtgtctatgctctggggttcaaatgacaatgttcacctgctttattcagatcaatttccagaaatgcattgctgactctccgccaactcaatatcctcaatccaaattgcataaatggtgttggatataattatctctctgaaaaatttcacctaaattggaattaaatttatttgtaaaagcaaagtcatcttgggaattatatttcaaaacctacggtcgaagattcagtgaatgaagctctttccttttgtttcttccacaatttcagctcctctttttcatgaggaaaattgaagcactcttcgggttcccactgctccctcctctgcactaattcccacatagaatttctctctacaaattggcctccactaattttttgcattggttgtgtcttgttgaatttttcaggagcacacttttatatacggggatgttgttttagaggtgggagaaagagagaattagagagagatgcaggaaatggaatgttgttttttttttattattatagtttaagttttagggtacatgtgcacaatgtgcaggttagttacatatgtatacatgtgccatgctggtgtgctccacccattaactcgtcatttagcattaggtatatctcctaaagctatccctcccctctccccccaccccacaacagtccccagagtgtgatgttccccttgctgtgtccatgtgttctcattgttcagttcccacctatgactgagaatatgcggtgtttggttttttgttcttgggatagtttactgagaatgatgatttccaatttcatccatgtccctacaaagggcatgaactcatcattttttatggctgcatagtattccatggtgtatatgttgcacattttcttaatccagtctatcattgttggacatttgggttggttccaagtctttgctattggggatagtgccgcaataaacatacgtgtgcatgtgtctttatagcagcatgatttatagtcctttgggtgtatacccagtaatgggatggctgggtcaaatggtatttctagttagatccctgagtaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtctcctgttttaatgccaagataacccgtcagaacacctgaaatatttgctacagttttgatgtttcatttatctcttagtggagcattgtgttgtttcagtgttttatcatgaagaactgtggctcttttaactgtaaggaatgagaactttagtaaaaacaacttttaatcactttgctataaatataatactagagaattcgtttcttggagtatgatttccctgttattcaaaaacaactacttgtcacccccttgtactttggccttcttttttcttctccccttcttttaactgttgcccctatttggagcgattatacttaaagtaatatggattctttcagagctgccaaaaggtgaaattgactttttgagaatgtattgctgaaaactgcagcagatgcactttttccatgtagaaacatcctgtgtgttaagaccgaaagggaccatttacagccagtttcaaattgctagctgaggtcaataagtgcccacttctgcaatcacatcagccccgtttggatgacagtacacaatgaggtgcctcccagggagtgaccacattggcagcaaaaccctttttgcaagttttatttggtcattcatagtagaaacctttaaaaatcttcaacatttaatttcaagcatttaaaaaatatatactgtagtaccatttacctataactggatttatttaaaaattatatggattggggaaaggacaccctcttcaataagtagtgctgggaaaaaaatggatatccgtatgtagaagagtgaaacaagaccctatttcttaccgtatacaaaaatcaactcaaaatgcattaaagattgaaacccaatactataaaactactagaagtaaacataggtaaaatgcattaagacactggcctaggcaaagattttatggctaagacttcaaaggcataggcaacagaaacaaaatatacaaataggactatattagactaaacagctttggcacaacaaaggaaacaatgaatgcagcaaagagaggatctgtagaatgggagcaaatatttgcaagctattcagtcaactcatatccagaatatatgacaaggaacacagtcaactccatagcaataataataataataatcccatttaaaaatgggcaaaggatctgaataaacatttcttaaaagaagatatacaggccgggcctggtggttcacgcctgtaatcccaacactttgggaggctgaggcaggggggtcatgtgaggtcaggagttcgagaccagcctggccaacatggtgaaactccatctctactaaaaatacaacaaaaattagccaggcgtggtggcagacacctgtagtcacagctccttgggaggctgaggcaggagaattgcttgaaccgaggggatggaggttgcagtgagctgagatcgtgccattgcactccagcctgggcaccaagggcgaaactccatctcaaacaaacagacaaacaaacaaacaaacaaacaaacaaaaaacatacaaatggccaacaggtataaaaaaaatgcttattatcactaattatgagggaaatgcagatcaaaacctcaatgacgtataatttcatcccaattagaacgactattatcaaaaagataaaaaataaatgctagcaaggatgtggagaaaagggaacttttatgcactgttggttggaatgaaaattggcacagctaatagggaaaacaatacagaggtttctcaaaaagactaaaaatagaactaccataaaatccagcaaaatcccactgtggatatttacccagaggaaagaaaatcaatatctgaaaggacctgcacacccgtgtttactgcagcattatttacaatagcaaagatataaaatcaacctaagtatccattaagagacgattagattaaaaatgtggtatatatgcacaacagaatactattcagccctgaaaaaggatgaaatgctgtttgttacagcaacatggatggaactggagggaggtcattatgttaactgaaataagctgagcacagaaagacaaatatgacatgttctcattcatatgtgggagctaaaaaagttgatctctggaggatagagagtagaatggtggttaccagaggctgggaagggtagagaaggtgggatgaggggaggctgattaataagtacaaacatatggttagataggagtgagttctagtgttccacagcatagtatggtgatgatggttaaaaacaatttattgtacatttcaaagtaactagaagaaaagatttgaaatgtctccaaccatagaaatgacaaatgtttgaggtgatggatacccccaattaccctgatcataacacattgtgtgcatgtatcaaaatgtcacatgtaccctgtaaatatgtacaattattatgcattagtaaaaaaagattttaaacaattacaacaacatccaggttttgttggttgtttttaatgcggcagaccctgtcctctattacattgaactgtcacacttttaagaagtcagtccaaactactatcttctttataccaataagaaggatcaggacacagaaagttaagtaaatggtccaagtcagtaaatggggattcatgattttgaaactttgtggtcagacttcaggtactgtcctcttaatgtcttgctgtgagatttgagatccaagataacttggcattgttgagatattgggaagctactatcagaatcagtcctctgcttgctttgttggtgtaaactagagataatttagtgtaaaatgtcccaataaaaattttcccccaagcatatgtaaaccacgacataatagatttatcaaagtagcagaatgctattatgttcaagagattaaccagaccaaagctatttgtcatagcaacgggtgctagagttgacaaattacaattgaacccagtttgtagcaaaatgttagacagagccttggcactgattaattgacgtgagagtccagcctagaatacattagagcaatttaaatatcattcaaaacagaatataaccatgctctctaaaacatcccaaactgtaccaagcaactacatttgattgattctataatgcaaatattttatgcctaagacttttaaagcacagactgtgttagtagcaagacacaccaccaatttagtaatttctaattaaaaagaaaatacattttacattaaatgcttatattgattgccaaggaacctgactacaggtcttttaaaacttgcatcatggggttgagagggacaatcatctcttagaaatttcttaaaaagaaactttaactctgggtaatgtgtttaccctaattagataagaaacctcatcctaataaaagtaatggactgaaggtgacatgtgttcagggagtcgggggggaaagagtttagaaagaggaaaagcctttgctttctaagctagaaaaatggatgttgaacttaaatctattcagacaatgatgagctagtcatattgtcacaagaataggttacctctttcttgcatttaaggttcccgttatgaaacagaaaacaagattatattctactgaaaataaagttgaaatggagtagaaaaagtggagtttcatattacttatcaattcttttttttttttcttttgtgagacagagtctcgctctgttgcccaggctggagtgcagtggcataaccttagctcactggaacctccacctcctgggttccagcagttctcctgtttcagcctcccaagtagctgggattacaggtgcatggcaccacagctggctaatttttgtatttttagtagagacagtgtttagtcgtgttggccaggctggtcttgaactcctgacctcaggtgatctgcctgcctcagcctcccatagtgctgggacccaattaattctttagtcaaccaacttcatttcttgatatgtcagttgtctgtgtgtgtgtgtgtgtgtgtgtgtgtgtgtgtgtgtgtgtgtgtgtgtattttcagtttttgtccatctgacagttgctgttgttttcattgttaggatatgagttccagttccagtatttctgtggcagagccttttgttctttagcatgtagggatttatttaggtctattacttgttttcactttctctttgccttttcttaaatttcaactttaataatagcctttaatagaataacagtgcattagctttcattgactacatgtatgctgaagaattcatgctaaagaaataataaggaatgtgtgccaagatgtggctatgaggatgtttattactagattgtttataatagcaagacagtggaaaattacccaaatggcctataacagcgaactgatgaaatcaagtatggtataaggctacagtggaattctcattagtttattaatcatttatcaaatattagttgagaggatattttgtatcagcccttgtggagtctctgaatatgtagccttcaagggcattaatagtgaaatggtggaagaatcgtcaatggcacagcaaaaggtgagcatatggctcggggagtccaaactcagtgtgatcttgttttcattaaaagataaaaggaaggtagaaatatgttttcttaagaaaaaaaaatgtacgtacacaaagataagcatcgctatgtttgactccttggatatttattctctaaatagtttgtaatgaattcctcatgtctttaagcaggaaacaaattgcaaatggtttaaaaaggcaattgctttaaaggattgaggagagcattggcacctatgtttctgttatctatgaaggtggaaggggaatcaagatggtttcagtcttttgtttttaaagcaaatggaattcttcaacatcttaactatcttttaactcttgctcttacaagaagtgatactttaatgtttaagaaaggcatgtattattaagaaaaaataagataaaataccaaggataccagcaatcacagcggactgagtggtatgtgaaaagataaacagtaaatgcttttggaaggaattgttagtcttctcgacagtttagcatttgatcttgttttgcgttggtagactgacttgaagtactagactgaattgggtgagacaaataaaagcatatactggagcagagagatccaatctttccctttctctgcaaggtttgtatttaggttataaaaataagtgtaggagggaagattagggcaaggcacagccttggtgcaagatgcagagatgagcagtcacgtatttcacacagagtaggatcagagattccaactagaaccaacaccaacagtgtgtggccccagggagtggcgctgcctctggtcaatgccacccaccagaattggactctaatggatagatcttcctagcactgcgtctggtcaatgccacccatcaggatcggactgtaatggagagatcttcttagctctctccctaaaagttgactgagccatctttccaattaataagaaaataccaaacagaacattaaagtttatagcttcacatttttgaattaaattacctattgattagtagggggctatcattaaaaattagcacaatcacgactgacaatgccttagaaattttcatcatgatgactttgatcaaattgtaaatgtgaatctgtactttattttagaactaaaggaggcaaatgagcaataaatttgaagcccaggtaattgggggaaaaagtaatcaatttaatccgtccgaagggctaagtgattcagagaactgacacttggatatttggttgaagccttttgtctgaaaatgtcacttgtatatgtttaagaaaatattctataccagacatacatttagtctttgcatctcttatgttgttagttttcagtttttaagcataaactcaaggtaacagttttcctgttagtttttagtttttaaacatacactccaggtaatagttttcctttctcccaatctcctttttttttttttttttttttttttgagacagagtcttgctctgtcacccaggctggagtgcagtggtgcgatctcggttcactgtaacctctgcctcccagattcaagcagttctctgcctcagcctcccaagtggctgggattacaggtgctcgccaccatgcctggctaatatttgtatttttagtagagacgaggtttcacgaacttggccaggctggtcttgaattcctgaccttgtgatccacctgcctcggccccctaaagtgctgggattacaggcatgagccaccacgcctggccctctctctccttgttgctactacgccatccagactccagtcactcaaagcaactacatctctcattccaagcaggtaccttcttcctcactctaatcccacattgtcttcacctctagactgatgatcatttatctctgacattttttgttcaaccacagcccacttatgcctgccttctcacgtgccgctcaagctcgacaactctacaggtgctaagatgaaatatagtgtagatgttaaaaggatttctctggagcctgatctccacatgtggttctatcttctgctagttgagttaccttgggaaattagcttagttttctgctacctctgtcttctcctctgtaaaatgtagtaacagtaacataaaaattccatagggttataattagaattagataaaataactaaataattgcaaataatctattatgtagagagtgataggttatatatgtagtgtctagagtgcagacttctagtgaaaatactgacttttggtcttcagtaaactagtaatatgtcaatgttggctttttcaaagtaatttttagcaacccttactagtgcacttagaaggtaaatattagcaaacagtacttaattgaacataccaccaccgacaatgaaattatggattacctacctgtaagaacaaaagaaaaggtgtgaatttttggattagtttatggctcaccagtgttacccctttacaaggtatacgcccacggtcgttatgttcaaaggttgaaactctagactactatatttaattctcctcaagaatcttagatatgaaaggaacagcaaaagtcattttatcaaaatttagtcctggtagaagaactccattaaacttggcatttggttatttgttttgggccccagtgatttgctaaagaataggttgagttctagagatagaaaaatagtaaggtaaagagccttaccccaaggggatagggggtagtcaggaagacaggcaaggaaacaggcaattgcaaaataaaaaccaggtgttaccagagtcatagtggctctcaaaggaggtacctctccttgccttgggtgggagtaagtgggtacaaagagaatttcagagaaaggtagcatctgagctgaaacctgaagaacaagtaggagttccccaaatgaagatagaggaatacagcaaagaaatttgcccagtgcaaataggaacatgcaagatagagaatgtgacgttcattcatggctgtttattattaaggtcctacaatatatcaggactgtattacgagaacttatgtaaatgtcagaccactgtctcctccacctctaaaatgagttttttcagggcagaaactgcccaatttatctttgctaacctaatgccttcagctcaatgtttatcaagtggaagatgttcaataattatttgttgaaggaatgaattaatcaataaatggtttatcacaatttcctcctgttagtgagaagcaaagtcattggaaaaaccatttaccagtatagggtcaggctagacacttgtaagcccatcaccagtgattactttcctgttggagagccatccattccatcagtattgtttggcacaaccattcaaccagcaaactgtatcttcatgggcctgtacacctgtcttattcatggatatttcacaagcgtaatggcagatgtgtgatttctgacctctcctccaacctggttgacttgggttatagcaacagagaaaatgagttttgcttggggttatttcttaataagctatcattgaccattaatcatcaacaaccacttgcctttccagtgtctcaccaattacgtatttcattctctgttctacctcccagcaaagtatcgggtctgttttaggatttacgtttttattagaatgtttgccccttttagcctgatagcacgtttatcattccaaaaccactggacggattccacacaaacattaaatgtttaaatgtgttcacactgaaacgtgtgggaatagcaaatggtcttttgttgtaacttttgaagatcttctgtaattcctctatttcatttgcatattgaagtgcttgcttatgttcaggaacctgtgcttagcgtttgtatatgtcctatggttcccaatattaatgagtcctggagaaagttgaatctgcaagtttctttacagtggccatcagggaatgaggtagcaggatgttaatgctgtctgcatgctgtgaaggatgataaactgtacttgggtgaccttattaatcactcataacgtgatcttaaaggtatgtgcattttctgtgcctcccagtctttgcgtatggagagggaaagatgggcattccctagtccccttaagctctaggtgccctcaatatctcccacttgagcatctgaacttcatctcagttttatgacagcagctggcatgcaaattggctggacttgaaagcactgaagttcacctcactttgctcaatctgtgcacaaatgatcaagctcagcaattttgaaaatggcccacccttttaaagggaaaacctgaaatattttcagtccttatggtagtcgggccaagcagtgtctggtagcccattcttagttctgttaccagcaggtaatgcaggttagcttgatgagcacaactctttgtcttctctccacctgtctctgtccattcattcatcccacggatgcttattgaatgtccactcaatgttggagcaacaacaggaaataaggacatggtttctgtccccatgggacttacattctacttggatatactagggagaaaaaagagtaaacaaaacaattagagatgataattattaagagtaaatgcatgggctgggtgcagtggctcacgcctgtaatcccagcacttttggaggctgaggcgggtaggtcacttgaggtcaggtgtacgagaccaacctggccaacatggtgaaaccctgtctctaccaaaaatataaaaattagctaggcatggtgacgggtgcctgtaatcctagctactcgggaagctgaggcaggagaatctcttgaacccagaaggtgaaggttgcagtgagccgagattgtgccactgcactccaacctggatgacagagcaagactgtttcagaaaaagaaagaaataaaaaagaaaagagtaaattaatgggatattgtaatggagaatcataatgtgtgtgttggctaaggttttcagaaaaaaaaaaattcatggtgacatgaaatttaagcagaaatctaaagtcctaaagaatgcgagggaatctggggaagcgtgctctaggctgatggaacagcaagtaaaacgacagggaatctgtgaacagtttaccttgcatgaggctctgaatgcagcacgtggtaagggagggggtggactaaaggctggaggaacagaatgaggccagaacacacaggctcctgcaggccaagatctgggtttgattgcaaacacaatatatagctcaagtttactttgtactcaacaaaatccattctgtctaccactggaaataatagcaaatacggcttgttggaaagtccgtgtgtaacttatctcttattattgctgagaggatcaggaaaaataactgttgagtattagactgaatacctgggcaatgaaataatctgtggaacatacccctataactcaagtttatataacaaacctgcacatgtacacctcaacttaaagtttaagaaaaaaagaatgctggtgggaatgtaaatgagtacaacctctatggaaaacagtacagagatttttcaaagaagtaaaagtaggtctaccattcggtacagcaatcactctacccaatactgggtctctacccagaggaaagatgcctgcttgcatatatttatcataacacaattcacaattgcaaagatacagaatcagccttagtgcccagcaaccaataagtagataaggaaaatatggtatattcaccttgaaatactactcagccataaaaaagaatgaaataatgtcttttgcagcaacttggatgaaactggaggtttcttctaagtgaagtaactctgaaatcaaaaagcaaatactgcatttcttcacttgtaagtgggaactaaggtatgaggatgcaaaggtatacagtatgatggacattggagactcagaagatgggagggtagaagggggatgaggagcaaaaaactacctatttagtacaacgtacactactcgggtggcaggtgcactaaaatcctagatttcaacactatgcaattcatccatgtaaccaaaactaacctgtaaccctaaagctattgaaatttttcaaaaaatatttaaaaagaaaaaaaagcaaaattttagatatggagaaaaaaaaagacatgaataagagcccttcagtccaaccagaatttgatttcactttcctctccttgtcattgtttttatacagctctttatctctttccaacagaaaaagtaaagaatttttccttttttatttagttttttaatgttcagagtggaaaagacataacttttcctacttgagcatttgtctgttttttcattgtaaatattattattgtccctgtagcctgggaggcctttcaaaggtcacttggccttttctagtacagtcacatgcccttcttcatttttaaatctttgagggggagaggggaatgagaaaatattccggaatagcactgtccaatagaactttctgcaatgacacccatgttctttatcatcagtgtctaatgaggtacctactagtcacatgggacttgtgagcactcacagtcaagctagtgctaccaaggagctgaattttaaattctatctaattagccacatgtggccaacagctgtcatcttggacaacacaactctagagcctcttctgaatgttatgccagtgaattcactgaaattcacaactggaatttacaccagtgatggtcttcatatgggcttccgttagtgactttggtgaagtttcaggcgagacctaaaggatgggaggggatctggggaagcatgttctaagctgatggaacagcaagtaaaaagatactcagtctgaggacacttgacctggcatgaagctctgaatgcagcccgtggtactagcccttggtaagtcgggggaggctgaaggctgaaggaacaaccttccagctcaattccaggtcatttctggtcatggcgaggtctttttcacaaaataatcattgttttcatctattcagtatccatttcctcatcctgtggtcctataattgcatttttcttaggggaccacctctcttgcatttttcctccatacttccagagagctggctccttaccgagctctagagttgggtatggaacctaaacctagccagctggcataactccaattcccagccacagggactggctcctagatgaccaagtggctcaagtctctccaaggagactcagtctcagaacacttgttaaagctgttagagactgaacacattgagcctgaaattgatggccatttctctgcccccctgagaatgtggccaacctcctagaaagaccacagggctaggactgagttccaattctctgaatgtagccctgctgcaatctataattatcctgaggtttttcacttatgtgaacgaatacatttctttttttgcttaagccaatttgagccagtgttttaatttaaaacctcacccccaaaaaaattctgatgaatacaataatgtcaaatatagcatttgtgacagtataaatctttcaaatcccaaagaactcatccctaagaaattatggagaggctaggtgtggtggcttatgcctgtaatcccaacactttgggaggccaaggtgggcagatcacgagatcaggagttcgagagcagcctggccaatatggtgaaaccccatctctactaaaaatacaaaaattagccaggcatggtgacgggtgcctgtaatcccagctactcaggaggctcaggcaggagaatcgcttgaacccgggaggtggaggttgcagtgagccgagatcgcgccattgcactccagcctgggcaacagagtaaggactctatctcaataataataataataataataataataataataagaagaagaagaagaagaagaagaagaagaagaagaagaaattatggagaaaactggacaaaactgggagtacagaagtggaaaatcacattgtgaaggagctagtgaattttctcccttagttatttagctggaaatatgaatccactgataaaggtggatttgcttggcccccgaggcagaggttgcagtgagcagagattgtaacactgcacttcagcctgggcaatagagctagactccatctcaaaaaacaaaacaagaccgaaaacaaaagaaacaaggacctcactttttactccatatacttttttttcctgtttttgcttttttaaacaataaatgtttgtaatttatatgacaataaagagtcttattaaaaagtatttcaaaaattttttttcttctagggtagatggtgtagttttcttattctttgaaaatacaaatataattgctccaagcaaatcaaacatataagagtgcagagagagagggaaaattcccccccagcccacacaagccttctaaatgtacttcccttcccagagaaaactactatgaatagtatctattttctatacattgacaaaaatatttagagatagtgggtatgtatgagagaaaaagatggatcaataaatacacatctacaaacatatatgatttggtttaaatatcgcctacctgtatatattcattagtatgcgtatgtacaggcatatatatgtaaaatatatatgtacctatatatatatatgtatatatgatattatgatgatattatttttctttttttttttttgagacttgctttgtcgccaggttggagtgcaatggggcgaactcagctcactgcaacctctgtctgcaggtttcaagcgattcttctgcctcagcctcccgagtagctgggactataggcacccaccgtcatgctcggctaatttttgtatttttaggagagatggggtttcaccatgttggccaggctggtctcaaactcctgacctcgtgatctgcctgcctcgggctcccaaagtgttgaggttactggcgtgagccactgcgcccagccaatattacttctttttctgtttaacagttgatattgtttggctgtgtccccacccaaatctcatcttgaattcccacgtgttgtgtgagggactgggtgggagttaattgaataatggaggcaggtcattcccacgctgttctcatgatagtgcataagcctcatgagatccgatggttttataaaggggaatttccctgcacaagttctttctttgcctgctgccatcgatgtaagatgagacttgctcctccttgccttccaccatgactgtgtggcctccatagccatgtggaactgtaagtctattaaaggtctttctcccgtaagttgcctaggcttgagtatgtctttatcagcagcatgaaaacagactaagaatacagcagtacatcaggaatattttccatgagctacatctccactgcaacattctttttagcaacagtgcagcattctgtagtttgtatgtatatccttaatggtttatcacccgccttttaataaacatcaggctgtttcctgtttttgcctattcgtgacaatgctgaaacagcttcattgcgcataagcaagacttctctatggcatctccaaatgatgactgttggctctaatgtataatacgagtgtatcttccatatccctctctgctaatgttccctgctgatgtaggataagcttctgtggcttgatcttggctgataatttgggtacaaatctaacaaaggcatgagatgtgttctaaacttacctctagaaaagtcagggttttttttgcagcaatgatgccacaaaacacattctgaggacaactcaccacgagtttgaagatgatttgtttggagcgatttgaaatcaaagttcagatttatttctcataagtctgttgtttagagggggatttcgtgaactgttcctatctatgtgccttatgcctgcaggctacaggtcctttatgagatggctatttttaaaggaacacctctattctcaggatggttgacaggacttttaatgaggaaagaaattagaaatcagagctggaggcaaagtggtcagcagaaaggaaagaaaaacaaggaacttgtattaagcagaaaggcagcttagtataccctttcaagtgtctgttattgtaaatattcttgtatatatccattagcagtcatgggtgagaactacagaattttttgggttatcatcataggaaagtacttaccacatctccacaggctcctcattttacttaaacttgaccaaatccagtagcaattgaaactgtacaaatcaaataatgtatttaatgcaacagggcaggggttggaaaactgcagcctgtgggccacatttactccacttggattattattatttctgtaataaagttgtattatgtatacccagctgcacctatgcaagcatatatttctgcggcagcttttgggtaccacggcagagctcaatattaggatagccctgcaagtcgaaaatattttctttctgcccctttacggaagatgttcgtcaacctagggaatctcacaatttcaaggtgttccctgttcaatttttttttttaatgtgagaaaagaaatcaatctctactcagaggctgcagagccttcctgggaggagagaagagtccacaaagttctccgtctgcctgggaggcagatgcagatgagaggaagtggcataggctgagctgtacctgctggattcattcttcttgtctccccagttgggaagttaaggaagttactctttatatgacagggaggaaatgagcaatggagagagcccatttctaaatagtagggctgaagtctcccatggataatgcaacacagttgtcagtgacacaaaatgatgtgcttgggtctgagaattacctcttatttggaggccgaattgtgtctccactacccccgattcaaatgctcaaattctcacccacaggacctcagaatgtgagtctgtttggagacaggatccttaggaagttaattcgggtttcatgaggttattaggttgggcccgaatccagtgtgtttggtgtccttataagaagaaaaaatcagaacccagacacacagagagaataccatataaacaacacagagggggaagatggtcgtctgcaagccaaggaaagaggcttcagaagaaaccaacactgcaaacaccttagtcttgaacttctaccctccagaattgtgagaaaataaatttctgttgtttaagccacacagtctacggtgctttgttacggcagccctggcaagctgacacacttctgctcaagtctatgttggtatcttcttagatatgatgcagatagtacacagatctttctgacgcctaagtcagcagccctggcaagctaatacacttctgctcctgtctgcattggtgtcttcttagatatgatccagatagcagagagactttctgatgcctaagtcagcagtcctagcaaaccctagcaagctgaagccaacacacttctgctcaagtctaccttggtgtcttctcagatatgatgcagatagtatagagagctttctgatgcctaactcagcagttctcaactgtggacaattttgctcctcaggagacatttggcaatgtcaggaggcatttttgattgtcataattagtggagcaaggcactataatgctactggcgtctagcgggtggaggccagggatgctgtttaacatctcacaatgcacaggacagccccctatgacaataagttacccagcctaaagtggcaattgtaccaagactgagagttcctgatggggcagaagatgcattactgtcaggctgtgtcttttcccttctccccattagacctttggtgttctttgaaggggccggaagaggttatctcctactctgggcattgtgtagaatagctatataagatcctcaaaataattgaaacggaaagactcccttcggctctttctgccattccagtaaattcctgctaagtatgctctaggaaaactatgaggtgctgtatgatttctgtgacaggaactgtggctttcctgaggaacagtcttcctttcaatgctgttaacttcccccaagtttgtggtctgttggtggttccggtgtgggcaaagaggaatgaatgattgatggactgtgagcctcccaagtagaagtgggctagtggggagtttttttaatatcatattttatatacaactgcaggtcaggccaggctatggatatacagtgcctgaccctagtacagaggaaggatcgattgtgctcaaacagtgagctatccaaataatttatttatgcagcaatgcagctgtctgcttctttggaggtgggcacaggctggaagggttttgtgtgtgcgcacgtgcgtgtgtgtgtgtgtgtgtatgtatgtgtgggcatggggtgcatttgtatgtgtatgtgtgggtatggggtgcgtttgtgtttgtatgtatatgggtgggtatggggcgcatttgtgagtgtatgtgtatgtgtggggtgcatttgtgtgtgtatgtatatgggtgggtatggggtgcatttgtgagtgtatgtgtatgtgtgagtgtggggtgcatttgtgtgtgtgtgtgtgtatgtggactttgagtgcatttgtgtgtgtatatgtgggtgtgggatgcatttgtatgtgtgtgattgtgtatgtgtgggtttggagtgcatttgtgtgtgtgtgcatatgttgggatgtggggtgcatttgtgtgcgtatgtgtgggcctggggtgcatttgtgtgtatgtgagtgtatgtgtgggcatgggatgcatttgtgtgtgtgtgtctgtgtgggcgtggggtgcatttgtgtgtgtgtgtaagtgtgggcttggagtacatttgtgtgtgtgtgtgtatctatatatttgggtgtggggtgcatttgtgtgcgtgtgtgtgggtgtggggtgcatatgtgtgtgtgtgtgtgattgtatttgtgggcatggggtgcatttgtattgggcttggggtgcatttgtgtgtgtatatgtatgtgtgggcgtggggtgcatttgtgcgtgtatgtgtatattggggtgtggggtgcatttgtgtttgtgtatgggtgtggggtgcatttgtgtgtgtgtgtgtgggcatggggtgcatttgtgtgtgagtgtatgtgtgggtgtggggtgcatttgtgtgtgtgtgtgggcatggggtgcatttgtgtgtgtgtaagtgtatgtgtgggtgtggggtgcatttgtgtgtttgggtatggggtgcatttctgtgcatgtgtatgtgtggatatggggtgcatttgtgtgtgtgtgtgtgggcgtggggtatatttgtgtgtatctatgtgtatgtgtgggagttgggtgcatttgtcttggggggcatagggtgcaattgtgtgtgtatgtgtgggtgtggggtatatttgtgtgtgtctatgtgtatgtgtaggagttggttgcatttgtgttggggggcatagggtgcatttgtgtgtgtatgtgtgggtgtggggtgcatttgtgtgtgtgtgtgtgtatgtgcatgtgtgggcatggggtgcatttgtgtgtgtatgtgtgggtgtggggtctatttgtgtgtgtgtgtatgtgtatgtgtatgtgtgggcatggggtgcatttgtgtgtgtgtatgtgtgggtgtggggtgcatttctgtgtgtgtgtatgtgtgggcgtggggtgcatttgtgtgtatctatgtgtatgtgtgggagtttggtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 428 - DNA, 1694210 bp, Homo sapiens; identical to SEQ ID NO: 427

SEQ ID NO: 429 - DNA, 939532 bp, Homo sapiens
ggtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtaatcacagtttgctttttctacctgtaaatgctcattggctttctgatttcccattaatttcctagctttaaattaccaagaattggactttttgtaaaataccaagttatcggaacaaagaccggcactctgggaaggcaaatgaaaaattccagtgtctctgtaactgagattgcctgttattagtaggtttctctgtctgtttggttttgtctacatttgaaaggaagcttttgaggaattcatggagcatgtctactctattccctcccaggtgagatggtgcccctccaggaaagtatcagaatgcagccattagggctggacatttctaactggccaagtctacacaggcataacaaattgagcaattgtggttatgatcacaatttctaaaactgggactctaaataataggttccagaagcaaattaaatatcaacaacccaattaccttttgtctctgctaccaagcatgaattctgatagtcattgtcttacttctctatgttcagagaattatatttaagggaagaagcagctaatgataatttactgattgttacaaacaatctacatgtcagctatatagagtcatctataggaattaattgtatgagctatatatgtcaggaatatatagagtattcttgacagtaaattagcattagcattaaaacgattagtattataattttataatactaattataactattagttaattagttcaactgttgagttgaactttctgcaatggtgggagtgttttatacctgagctttccaatatagtagccatgagccgtatgggcctactgagcatttgaaatgtgattagtgcaactgaggggcttttaaaataattttagttaatataaacttaaccccattgagtagtggctaccatattggacagtatacgtctataggccctaatctcatctcctctttaaaaagaatgaatatgtatctttattaataatctgtgttcatatcttatataacatacctaaaaatgtagacaaggcagggcgcagtggctcacgcctgtaatcccagcactttgggaggccaggtctggcggatcacgaggtcaggagatccagaccatcctggcgaacatggtgaaaccccgtctctactaaaagtacaaaaaaaaaaaaaaaaagttagcctggtgtggttcggacgcctgtagtcccagctactcgggaggcaggagaaaggcgtgaaaccgggaggccgagcttgcagtgagctgagatcgcgccaccgcactccagcctgggcgatacagcgagactctgtctcaaaaaaaaaaaaaaaaaaaaaaagtagacaaaaagcctacaaacagacacacccaactgttaagacctctcaggttgggattagaaaggtatgaagaaaggattttaacatcttgtcttgcctaatcccaaaaagaaaaaaaaataggtgataagattaaaaatgaatcaaataaatcagatgcaaccaattatatcatggaaccagttatgtcagtccatctctttgaattaaaattaaaggaaaaaagatggagggttctgacagttatctctctaatcgagacagccctctccctctctctgtccccttacagagaaagtgaatttgggagcttcggtcaaacatcccttgtctttcgtcaaattagtgcctaatgtcatcattttggtggctttcaaaggtgtgaaccagcaaacgggtgacagtgagaggaaggaacaagcatgtgaacaaatgcgtgaaccacagtcagtctctgaatggaaatccatgtgtcttatgaaaatcagttattgttgaaagccatttgcaaagcttccacgatcctcgcttggctggtgcacggctgtgagtgcttctttccaagtctcctgtgggtgacggggaatggctaaccagggattgtgttcacaggcatatcgattccaagtctgatcacagccacaaatttctttcccaggttagtaagaagaaatcaacactttactttcttggatcatatgtttttaaacattagtactgaggaaataaagaaagggagagaggaagaaaaaagaagtacaagaaagaatacactgggctgggcgtggtggctcatgcctgtaatcccagcactttgggaggccagtgcagacagatcactaggtcgggagatcgagaccatcctggctaacacggtgaaacccagtctctactaaaaatacaaaaaattagccgggcgtggtggcgggtgcctgtagtcccagctactcggggggctgaggcaggag[135 bp omitted]caaggagaagcaacacagtgcaattctttaaagtgcatacaattaaaacacatagaagaggaaccttggctagaattacagagcttgatcaagtctcatccatggttgacactgtttgttggatgatttggacatttggagcctctctatgtggggagagttttctttatccctttcaaatcggtatgccatctctacatacctgaattattataaaggtaacaaggttataagctcccccatgcctgccaggatgcactgctttgctgtgactgagccacactaggtgctaaacttttctgcactaatgcaatcaaattagaagttaaatctgatactgtaacaagttaccacctgggaacagaaatgctttgctgttttattttttcttcgtagcattgtgaaatgaacatggcatgtggcacattttaattacagcaaatattaatttttaatgggaaatgtacacctggctttgtattgttcataaattatctgagaggttgaaatttatttacgtgattttgatgcagttgtaattaaagtgaagaaactaatagccttctgtaattgaaggcacattaatctgaaagctacctgagggcagggattctgtgttaaccgtgttgtatactcaatttagtaaaatacgagtcttgggattagtggtcttgtatgcgatgtgctacacattttccagatatttctagggtattttctgagctttagaaaagtgataatatgatctagtactgtaggtaattatgtgctaagaaaagaggattctatcacattatctggcattgcttttttagttttgtaatggagtaattgattagtactactgcattttagcaaggtattttgctcctatacctagtggatgatgtttaagttaactctatttgtgtgtccctgagaaagagaaccgaggcaggcgctcggggaatggaacagggacaaagaaaccaaccaaataacactaggtatcagttttcagctgcatgtaaactcaacttattttttaatgattttattaggaagctttctacattctattttgtaatgcatttccctgagggaactttagaccttgcaggcctgtttgcaattcctgtcagattaggggggaaagaaagagaacagaatgatggaaatttcacacgttattcagtgttttaaaaatccagtttcttagcctgacagtttcttaaatctgtagaccttgatgttttaatcttatgcattctgatggagcttgatattcataactggtgggcttggtaaatttttaatcaggaagttgaatatgatgagaaaacacaaggggaggtttgtgttttgcaccttgtcatcaagctttccagtttcattttcactttttgcactaagagtattcctcagaggtgtcagagctgcccaaagctgacttccatccatattgaaatgactttttctgagctttccaaaattccaatttcagtgcaggtggtaatatctgaatgtgagcagcagaataaatagcagtttaaaactcatataaatatacatttatgctccatgtgtgaactcataaggtgtgggataaatcttgtcatttcaacataaacggaataacaaatagattgaaagtgggatgcactgttgcgaatacatgatctggatgcgcagtgcgattaaacagtgatggcttcatgagaatcgaatttcaaagatcacacaatcgattaaaacaattcagtctccctggtcatttttgtcagtaaattaaaacattaatttcatcccaagaatgtttttcagtgttttttattgtacaaagtaacaaacacatgcaaaagtagagaatagtaacatgattcctcatgtacccatccccagattcgataattaaaactcatagccaatcatgtttaatctatatccccacttgttttctccacattcctgaattgttttaaagccaaggccagacatcacacattttatccataaatgtttcagtatgtatctctaaatataattacacccaatccttcaacattaacattgattccctaagatgattaatatctgatcgctgttcagattttcccagttatcttacatatttataaagtttccttgaactgaaatccaaacgaggactatagaatgcaattagttaatatggctagagttccttagtctataaagagtaaagaactttccattcatattttactctcttttttcttagaattcttaaattaaagaaactagattgtcttcctgagtcttttgtgaaaaatatgattgtgaattttcttgtttatcgcacacaataaatccaccttataaattattgattgaaccaataaaacctatcaaaacaatttaattgaatacacatacaccacacactctagttttttttttatttttaatttttatggttatggaagagttgtacatatttatggggacatttttataaaagcatacaatgtgtaatgatcaaatcaaggtaattgaagtagcctaactttaaatatttatcattttgttgttttgcaaacattccaaaactactactctagttattttgaaatatacaatgcattattgttaactatagttgtcctattgtgctagtgaatactggatcttatgtcttttatctaattgtatttttgtacctatgaatttacctacttctaactcccccttgctctcaactccccttccttgcatttggtaaacattattctactctgtatctccatgagatcaatttttttagctcccgcatttgtatgagcacatgcaatatttgtctttctgtgcctggcttattttagttggcatcatgtcctccagttgtgtctatgctgtttgaaatgacaggatgtcatgcttttttgtggttgaataatattccattgtatgtatgtaccacattttttcattcggttcatacattggtggacactcaggttgatttcataacttggctgttgtgaagagtactacaataaacatggcagtgcacatatctcttctatacactaactttctttcatttgaatatatacccaacagtgagactgctaaattatgttagtgttagttttagttttttgaagaacctccatactattctccagagtggctgtactaacttacgttcccaccaatagtatacaagggttccctcttctccatatccttaccagcattcattattgcctatctttatttatttatatatatatttatatatatatttatatatttttatatatttttatatatacttttatatatttatatatatatttatatatatttttatatatacttttatatatttatatatatatttatatatatttttatatatttatatatatatttatatatatttatatatttatatatatttatatatatttatatatatttatatatatttatatatttatatatatttatatatatttatatatatttatatatttatatatttatatatatttatatatttatatatttatatatttatatatatttatatatatttatatatttatatatatttatatatatttacatatttatatatatttatatatatttacatatttatatatatttatatatttttatatatttatatatatttatatatatatttatatatttatatatatttatatatatatttatatatttttatatatttatatatatatttatatatttttatatatttatatatatttatatatatatttatatatatttacatatatatttatatatatatttatacatatatatatttatacatatatatatttatacatatatatatttattcatatttatatatatttatacatatttatatacatatttatatacatatttatagatatatttatacatattatatatatttttatatatatttatatatatttatatatatttatagatatatttatatatacatttttatatatatttatatacatttttatatatatttatatacatttttatatatttatatatacatttatatatatttatatatacatttacatatatatttacatatttatatatatttatatatatatttatatatatatttcttttttgttttttgttttttagttgttggtttcttttctttcttttatatatgtatatatctatattgcctgttttttcagagagctattttaactggggtgagatatttcattacaattttgatttgcatttctctaatgattagtgacgttgagcatttttccgcataccttttggtcatttgtatgtcttcttgagaattgtctattcagatgtttgctcatttttatttggattatttgggttggggttttgtaccaagttgtttgagctcctcacatgttctggcagttattctcttgtcaggtgggtagttggcaaatgttttcttccattttgtaggttgtcttatcacttgtttgtggttgcctttgctgtgcagacactttttagcttgatgtgatcccatttgaccatttttgctttggttacctgtgcatttggtggcttactcaaaaagtatttacccacacccatgtctggaagcatttccacagtgttttcttgtaatagcttcattggtccaggtcttacattaaattctttaatccgttttgatttgatttttgtagatggtgaggaatagggacatagtgtttggtcttcattatgttgatatgatatgtcacatttattgatttgtctttgttgaaccatccttttatcgcaggaatgattcccatttgatcatgatgaatgatctttttaatatgttgaatttgattcggtagtattttgttgaggatttttgcattcatgttcatcagatatattagtctgaagttttcttttttcgttgtgtatttgtctagttttggcattaggataatcctgatcctgtagaatgagtttggaagtattgtctactccttgattttttagaatagtttgaatagaattggtattaagtcttccttaaatatttggtagaattcaacagtgaagccatcaagtcctggccttttctctggtgagaatctttttattacttcttttatagcattacttattgatttatccatgtttactattatttcatgtttcaatctttgtagttttttatgtccaggaatttatccatttcttccagattttccaaatcgttggcctatagttgataaaaatactctctaatttacctttgaatttctgtggtatctgttttaatattttcttagctctgatttcatatatttggacattctctcttttttcttagcgtggctaaaggtttgttgatttcgtttttattttccaaaaacaagtttttattttgtattttctctcaatttcatttatttctgctctgatctttagtgtttcttttctttgactagttttgggtttagcctgctcttacttttctagttctttaagatgcagttttaggttttttgttgctgctgttgttgttattgttgttttttatacggagccttgctctgtcactgggctggagtgcagtggtatgttcttggctcactgcaacctccgcctcctgggttcacgtgattctcctgcctcagcctcccgagtagctgggactacgggcatgcaccaccacacccagctaattgttgtattttcagtagatacagggtttcgccatgttggccagggtgatctctgtctcttgacctcgtggtctgcccacctcgggctcccaaagtgttttgttttccttttttgatacaggcatttattgttataaactaccatcttagtactgcttttgctgtatcccataggtttcagtatgctgtgtttctactaaatttccttcttaaattatttaattcatccagtagttattcaggagcatgttatttaatttccatgtatttatatagtttccagagttcctcttattgatctcttcatgttttctattttttcatggttcaatcttggtaggaattttatgtcccgggatttttatgtccaataaatgcttattgatttctagtttcattccattgtggtcagaaaagatacctgctatgatttggatttttctgaatttctgagacttgtgtttcggcctaacatatggtctaccctggagaatattttatgtgcccatgagaagaatgtgtattattcagctatcgaatgaaatgttttgtaaatgtctattgatcaatttgttctgtagcgcacattaagtcagatgtgtctttgttaattttctttctaggttttttgtccaatgctgaaagtggtatgttaacttagcattcccaactatcattgtgctggggtctgtttctctctttatctctaataatatttgctttatatatctgagtgatccagcattaggtttatatatatttacagttcttatatcctgttgctgagttgacttctttatcattatataatgaccttctttgtctctttttacagattttgtcttgaaatatattttatctggtataagtacagctctttatgttcttttttggttttcatttgcatggcatatctttttctgttctttcattttcagtctgtgtgttttcgtaggtaaaaatgagttccttataggcagcatatagttgggtctttttaaaaaaaaatttattcagctagtctgccttttatttggagaatgaagtccgtttacactcattgttattattgataggtgaggacttactaccgccatttagttgttttttgttgttgttgtcattttgttagttctctcttcctttttttttttcttcttgtcttcctttctatataagcaattttctggtaatgttttaatttctgtcttttaatttttttgtgtccctgttaaaggtttttgctttgtagttaccatgaagcttgcaaaaaaaaaaaaaaatcttataaccaattattttaaattgattaaagcttaactctggtcacaaagaaaaaacattaaaaaggagaaaactaaattctacgctttatctccatctcctgcagtctgactttttgctatctctgtcttttttactgtctttcaacaaattgttgtagttattattatttttcataggtttgtcttttagtcttcgtactaaagatatgagggctttacatacaattataatattagaatattctgtatttatttgtgtgcttgcttttaccaaggagctttagaccttcaggtaatttcttgctgcacatttgtacccctgtctttcatattgaagaactcccttcagcattccttataagacagatctagtgttgatgaattacctcaggttttgtttgtctgagaaagtctttacttctccacgtttgaagcataactatgctgaatataatgttctagctttgaaagtctttttgttcagcactttaaatatgtcatcccactccctcatggcctataaggtttctgctgagaagtctgctgacaaacatttggacttctttatattttctttgcttattttctcctgctactcttagggtcctctttttgtccttaacctttgagaatttgattattgtatacctctgggtttcatctgcttggtgttgcttgactttcttgtacctggatattcactgggtttgaaaagttgtctgttatttttttgaataaactttctatcccaatctctttctctacttcttcttcaaggccagtgactcttagatttgccgtttttaggttattttctaaatattacaggcatcttttgttcttttttagcttctttttttctctacagactgtattttcaaatagcctctctttgagctcactgattctttcttctgcttcaccaattttgctgttgagacactctgatgcatttttgtgttgttgattgcattcttcagctctgcaatttctgtttgatttttttgttattataatctctttgctagatttatctgatagaattccaaattcctcttctatgttatctccaagtttgttgagttttctcaagacaaccattttgaattgcctgtctgagaggtcacatatctctgtatctctaggattgatcactgatactttatttagtccatttggtgaggtcgtgttttcctagatgttctccttgcatgagggcatttgttaatgtctgattttttttttttataaaggtgctttattgtgtggatagttgttcaatttggtgttcctgtggtcgggggttgtggggaagtaaatccctggaattttctatttagccatcttgttccacctcatatatttcattgttttaagaaaaatgagtagaagttgaaagagttgtataagagctaagtgaaggtcggctggagttattgtcaccaagcactcttctaagttgcttgaaaaatagcacaagcagtgtttcttaactgctcatataggggatctttcttccttgggtaaactcatggttggcattgacattgatttgttgcacttctgagtgaaaaaaaataggcatttaacataaaagagattactcttaggaaatactggatgtgactttagaaagtggtcatggttccttccaaaaatattcattattaaatatagtgttatatttcatttctgaacaaagagatctacgagatctggtctgctctggagaaaaaaaatgacaaaggagagaatttgagggaatctcccagtccgttcgtaactaacataagagtttatgcaaaacaagaattattctaaacaccatggatggtgggccataagccatctcatttatccagacatctctgtggttcagcaaatttcccagttgccctgtgtatagagcttttagggagtggagttattgttgctaaggagaggtcactgtttttaggctgggcaaaactgcattgatccttaggaagaatctagactagacaattggcaataaaagccatttgcatctgggcaacacctttccatcctaccttccccaaagcacactcagcagtagttcctcttaccacttaaataaaaacttcaacatgtggggacaagttttccattaaataagctatttttcctttgttttcaactgcacaataaccatcagaaacacttacctaatatttatttccacgttccatgtaccatgttccatgtgagcatgttacagccactgtccagtttaatatcatatgaatatgaaataccaattccactattgttatcatcattttccagatgaggataccaaacaaatgcaggaaacaatgagagcatgatgagaacttactttagaatacagagctagaattagactcaaagtccattagactctaaaactgatgctgctcctcaggctccgcttagcatttacaaaaaatggcactgtgactgaggaaccttgtgtacatgcatgtgacttcccaggtggcacttaccaacagaccatccttccaaatagctgctccttaaacaccccatcttgagcttagagacacacacaaatggtagtgtctgcactggggaggatgtacctggggcagaagcctgttcagggcctggagtgggctttgtcactttggcaaaagtctgcatgactttgggtccccctaaatgaatggagttcgggggccaggcgaagattcccatgaccctgttgactcctcattccttggggaggggtatgtcagaagagggtcagaactggaccctcacaagtatgggcctggccaggagacggggctttttggctctgagatctcttaaccacttgttataattcttcccacattacaaaggcccacaatgtacccccacaatgaggagagtccctgttgtcccagacagcattattcttcttgtacctttgggcttcatgcatcatttttcaggaggtagatcaagtggaagaaacatttttacagggaaaaagcagaaaaataacaacaaagagctgtgtagccccttaaaagactgtagctgtgaacatttcagacagagttcagagatcctggaaaggaaacagtaagccaaaaaacctctccaaaaattaataataaggacaaagctggttcccctgatccttatgaaggggatgaggagaatggatggtgctctgtgcgcatttagaggtcaagtaggtcaacaaagttctgttttccctgaatggggaccctagcactacggtgctcccatctagctctttccttaaacagttggaaatgagatacttaaagaaactccacccaatggaagtggacatgaggtcacatcgagggtcatggtcacaattgactaaaagggtagggaattgatttgaggatagcatatttcagaccagaaggaagagaattgcttagccggcaggcttttttacttttaaaaaaaaaaaggcttattgactcttagggaccttatctgaaagtgtcatgaccatgtctccctctgcacaggtcacccatctcactaaaaacttcctgctttggggttcaggttggaatgtcagaaatacattagttgatttgaattttgaatacgtgaaaagaaagcatccctcatagattgtaccttcaccgaaatgcaatgatttcctgccccaattgagtgctctccaagaaacgttgatgaaacatttatcagatgtgtggagtgaaggtcgtatgtggcacgcttggacagaaataagctggataaagcaggcagcattctctatgcagttccctaactgatcggcccgttctaggcagcataatcttaagagcaaaagccaggttggtcctgccatgttcgtgtattcatcaataacagcacataaagaagttctttcaacttaggattttatgcagaaacggtgaaatgattaacatcagaaatagcaacaatgccgtgtgatttccaaaattattttatttttctcctggttatacagttagagtgtgaattggagtctccctgtggttaagttgaagttgtgtgactgtatgctgggcaatagaaattgggtgtaaactgtattaatttgtgccaattccagatttagccgtaaatcacctgtgacacccttcacagtctctgttctccatccactgtgaccttggaggccaggttttgaagacacgttattacaagatgaaagagattgcatccctgagtgattcatgatcgtagcattccattgattactctaaaccaagctgcaaatgagcacagagcttctgctggcttaatccccaaaacctggagttgtaaaggacttagtcttcctccataatacaacttaatccacgtctactgaaatagaagtatatttatattctataaagttaacataagcgtaactcgatactatagagagaagttttaatattaatagccaatctgtcattactaaacagctggtgaaaggccaatgaggccgggcacggtggctcatgtctgtaatcccagcactttgggagtccgaggtggggggaccgcttgaggtcaggagttcgagaccagccagaccaacatggtgaaaccccatctctactaaaaatacaaaatttggcaggtgtggtggcgcatgcctgtaatcctagctactgggaaggctgaggcaggagaaccgcttgaacctgggaggcggatgttggagtgagctgagatcgtgccagtgcactccagcctgcaacaaaagtgaaactccatctaaaataataataataataaaataagccaatgaggtctgctgcatcatacctgttctgatttgaataggatgtcccttttccaaaattccccagcatctgcagagtattttattcaggttcaacacaagctggtgaggcatgtaactaccttgtaactagtttcataataattattatcgtctctctgaaaatagtcagcctgctttggacacaggtgctgcactgattttttttttattattatttatttattttttattttttatttttttgagacagagtctcttgctctgtcgcccacgctggagtgcagtggcgtgatctcggctcactgcaagctctgccttctgggttcacgccattctcctgcctcagcctcccgagtagctggaactacaggtgcctacgaccatgcccagctgattgtttgtatttttagtagagacggggtttcaccgtgttagccaggatggtctctatctcctgatctcgtgatccgcccgcctcggcctcccagagtgctgggattacaggtgtgagcgaccgtgcccggccccccactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaacttcccgagttcctcctagcattctctattctttccgccgcacaatgggacatgtggttttattccctgaaaagtcacttctggatggacccagtctgaagatggttctcctgctgtatagaaacatggatgtcgcgaaattgcctattaaacagggaagctattaaacagcctccctgaatttaccagattaggattttagtgaaaaattaccgcctgcccactgcttgtgggtagagtgttcttcagaagaaacattaaggtttaaagactgtaagtcatgaaatgcacgtgacaagatgaatgtcattgtatcatttcccaagccgcgatccccatggttcaccagaacttaaatacagcagttgatatttatagccagtggtataagaccttgtcttcaaggtggtgagtttccgctttgagatgtattccagaatgttacaatgttaaggggtcctaggtgttaatatcaattttataatttttaagacaaagaaagtgaagcgtgtggaaggcgagagaaacactaatggtgtcaagttggtattttagagagaagcagtcatttcattctcagttattacctatgctggttgtgcaaatttaagcaaattattgcactcaataggcgccattttctgtatccatagacagtggggactgtttgactcagtgctgtgcccatctttgcataaaaggcatttttacatttgtgtgcattggtgtgagttgtctgtttcttttgcccattttcatccttttcttgtttcattttctccatgtcttcgaattttcacagtaatttacacagaagtctgcatagtagtctcttagttttttaaaaaatcttctgtttgaatggtgatcctcttgtaatttctcattttctgtctttgtgctttctcccacctttttcttcattaagtggttagctactttttttcttattttcaaaaaatacccttaaaacatatgatttggtttattaattagatctataattattctcttccctaacttattgatttctggtcttccgtaacttactggtttcttacgtttatgaatcctttcttaagcttttttgtttgtttgaatttactgttatttttctaaatttttgagatggagatttaataaacttatttatatttttctattatattgaaatttttcatgctgtgaattttcttctggttctgatttaaatgtgactcttagattctggattttattttattctattattattattattattattattattattttatgacagactctcgctctgtcagccaggctggaatgcagtggtacaattttagcttagtgcaacctctgcctccagggttccagccattctcctgcctcagcttaccgagtagctggtattacaggcacccgccaccatgcctggctaatttttgtatttttagtagagatggggtttcaccatgtttgcctggctggtcttgaactcctgacctcaggtgatctacccacctcggcctcccaaagtgctgggaatacaggcgtgaggcactgggcatggcgccctccatcgttctttttgttttgtttgcatcatagtttgcaaagtgtggttctcctttcctatttagcctctattcccccaaaccattgttttcccaacactgccttctccaattcagcacatgtttttaagtctctttactgtagttaggactctgagcttcctgttctgtctgtcattattttcacttgtatggtggatgtgatttcagttcagtcttggctctccatccctcctcttcttcttctcctgtgtctctagaccctccttattcttgtcaaaagctcaggatgggaaataggaaaatagttctgctagagggtggtatttattttcaaatcacagttatttaactttatagttttgtgtgtgtcaccaaattatggtaaaggatggtatttgtgtggtttattttttcctgtttatctttttttttttgcaatggggtctgactgtgtcacccaggttggagtgcattggtatgatcttgactcactgcgtcttctggctctcaggttcaggtaatccttccacttcagccttctgagcagatgggaccacaggcatgccaccacaatacctgactaatttttgcattttttgtagggatggggttttgccatcttggctaggctgatctcaaactcctgacctcaagagatcctcccgcctcagcctcccaaagtgctggggttactggtgtgagccaccacacccggcctgttcttgtctatctttatagagttggcagaagatgctaggagattccagctgccattgactcagctgcatggaaattgcttttcttttttaatacattcattatatatgattagttattgattattcattttaaaatactttgcatcaaattatttctctttccaggcaggactggctgtctaataggtgcagccctgtgaaaatgaaagttcagggccccttcctaaaaaattgtaaagaacttcaagatggcgaaagtagagcatcacgccagtcacattggctcacacctgtaatcccagcacttcgggaggccgaggtgggtggatctcttgaggtcaggagttcgaaaccaacctggccaacatggtgaaaccccatctctactaaaaatacaaaaatcagccaggtgtagtggtgcgtgcttgtagtcccagctactcgggaggctgaggcaggagaattgcttgaacctgggaggcagaggttgcagtgagcagagatcgtgccacactgcactgcagcctgggggaaagagtgagagtctgtctcaaaaaaagcatcaaaccaggtgcaggaccctttgagtggcatccctgtgtgtacacagtcatacctccaggaaggtggtactggttcaatacttttatatattaagtaactcttgtttaataactttatatgtgttaagttatctaacacagagagagagagaactagagactggaacttaggagagccgaattctattcccaaatgtgtcttggatttatagtctgactttgaactctggagttctgttttcctacttgaaaaatgaaagattttaccctgaattgcgtttcacgaactatcacatatattactgataatacctaaatacattttaatagtggtattaattatatcacataaatagaaaaaaattgaaacacataaactatgctttttctgtatattttttcttagcaggtagttaaggtgagtaataacaaaacaaggtcaattttaaagcactattggagaattataggtgatatttagattttgtaagaattgtgaagattacataaatacatctaaagtttggaaaacgttgctcaggatgatccctaaggacgctttcaagtcctttcagcattttaggattctataattgcatatctttatgcagaattatgcattttttgatttagcaaataggtagatttaaatatataattaaaggtcaacctgttcataccttccagaaagactggggtgagatgaattccatatttttgtgtcatctaccaccacaaattttatttcaatttcatataaaggttaaaaattgagatgtccccatgtacactcaacgccatgtagtactgtgcctcctactacgaagtcagggttgcaaaaagccttcatgtaacattgctgtctatggtaacttgatgtcatgtctttttcatttctggttttcatgtctgttgtatctgacattctaaagaattcaaaatagattgttcttgaaggggatataaatagaagtgatgggccggcatggtggctcacgcctgtaatcccagcactctgggaggccgaggcagatggatcatgacgtcaggagttcaagaccagcctggacaagatggtgaaaccctgtctctactaaaaatacaaaaaattagctgggtgtgatggcgggcacctgtaatccaagctactagggaggctgaggcagagaattgcttgaacccgtgaggcagaggttgcagtgagctgagactgcatcactgcactgcaggctgggcgacagagtgagactccatctgaaaaaaaaaaaaaaatagaagcgataatgctgtacatctgttagccacttggatgctctctgccagattgcacaaaagttcatggtacgcctgctgtcaccagatttgggtattattttttaagaacccagaaattaaaacagataatatgatcctgttgatcaaacagtataatttttaaaaaggtactgtttgttaattttaagaacattccagtagaccgattggaggagaaatgtggtccccctgttaggcttagattttacataaaatttttaaagtgaaatttgattggagaagttgagttttttttccaaaatatgattttcttccattgagattgattggactctataggttcactgcaggagggtgggacattcttacctgttcgtaatacagaattctctgagagaaatatcccttcatctcagtgtctcagtggacattgttggtattcctgagtgttttgacattttggccatttccaaacatttctaggtctttgttattgacctgcctacatttcaattcttggcccttccctctgttttgaaatgactcattcttcacaagagcaaactgaaagctttactgttaagcaaaaaaagaaatcttgagccaaagtattataacttgctctgtaggaaatgaaaacagtgcattggccatcttttcaccctgttgttagagtatattaaattaaaataacacagcaagaaacattagtttccatgattcattttagatttatgttggtgtgtggatttggttggttgtttctttggttagtagaaggtgatgtattaaagtggaggtctggtatagctgatggaaatgagtttttttaaaaaggttatgaaacatctatctccctcttgagcagtagtccaggggagtgatcacatactgagatgaaaacaagagggtggtaatacagcaagtggtgtatgattcagtaactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgatttttttttttttttttttttacaatgaaggcattccaatcgggctaatacaaacatgaggcattctcaaactacaggaaattgctttccttaactacactctttgaaaaaaaatggggtttaattacctgctgcttttctattgctcagattcccttcaggatgcagggggagggatgggagagaagtttcctttgtgatttaatgtaattattcataatgactacatatggtcattttataagttcctaattattttaagtgattggtgcatggtcatttgcataggctgtttagcagaaaactcattcagtgacctacatataaatcatggaatagtttctaggcatgtaaagcgggtgagagaaaccaaacccttccccccatcacttatggttccaatgtatgcatcccagaatgtttaatgtaaatcataatagcagcttggatccagtattcttcatacaaatgtgtggttgatgtagggaaacatgtttaatgttttctttcagtagcagatggtacatggatttttatttgatgcaggcactgctttccaaggtaattgtcaagggcttttttccccctatgaaaaaaatggagggaaggcctctggatcaacccattcatttcacagatgagcaaactgagacctcaaatattgagtaattttccctaaatcaccagtttttaaacagagtgagggctaaaattcacatctcctgacagtcagcttaattctcttttcgtcatactgcacattttctcttgatagttgatgtgatatatgtcactttaaaaaaatgagtttccatttctgggtatattttatctactttcctcctcagaaagccaagttctgttgattcatagtaaggaccagatatttcatagtgctaattccaagctgggtataatttgtgacttctaggttacccacttgtgtccacaaaccacctaaattttttaattgtacacagtcaagtcaccttgatagaaggggccttgagagctcatctaattcagtgatttttccaacactggtttcagggctgctgatgtgctattgcatttcacccgagtccacaacaaaataagaagaaaaaaaatcagctctggggagttttgtcctcaagttaaattaattcccattttttttaagttacgtctttatcaaatgttgatgcttaaagagagacattgttggctgcgcacgttggctcacgtctgtaatcccagcactttgggaggccgaggtgggtgaatcacgaggtcacaagttcaagaccagcctggccaatgtggtgaaaccctgtctctactaaaaatacaaaaattagcctggcatggttgggggtgcctgtaatcccagctacttgggaggctgaggcaggagaatcgcttgaaaccagaaggcagaggttgcagttagccaatgttgcaccactgcactctagcctgggtgacagagtgaaactccatctaaaaataaaaaatgaaaaaaaaaaaaagatagtcatcgttgctttcttttattttcatgagaaaacaagaaatgacacatgtatgtcagctttccacaaaatcaccccctgccttccctttccttttatgttcttatgtttttattgtgtttacctgtcagtgaatccaaacattgagaaacattgggataagggaatgttattttctaggaaaccaaagttttaaaatatcatggttactgtattagtccattttcatgctgctgacaaagacatacctgagattgggcaatttacaaaagaaagaggtttattaggcttacatttccacgtggctggggaggcctcacagtcatggcggaaggtgaaaggtatgtctcacatggtggcggacaagagaagagagcttgtgcagggaaactcccattttttaaaccatcatatctgaagagacttattcactatgaagagaacagtgaaggaaagacccacccccgtaattcagtcaactctcactgggttcctcccatgacacttgggaattgtggcagttacaattcaagacgacatgtgagtgggtacacagccaaaccatatcagttactatagtcattttttggcaaaaccaagaaatagcaaacttgagcccgattccttaaaacagataaagcaccctaaccccccactgccaaatcaacactcttccactatatcattttccattttcaataaataactctttcatccactgtaaataacagaatagatgttgtctatgaattcactgcttaatatttcatttatctacttccttctacccttattcatacctatcctaaacacttttcaaaggaactttctctctgtctcttgttaaaaattttctcttgtaattcttaaatatgtacagatgttaccaattggtaagagattcttttttgatgaactttctctcctgggtacacatttatgatcctaaacgccccatgaagatgggcctacatctgccttccaacttcttctatgtccctcagtcataaatatctacattgtttctttgataaattttgggaatgatagaagacaataagttgcatgatgactgcttgtcttgttctttgttaaatgtacctatgtctccaccccctttcttccacatctcaaattggaaatcattgagtactaggagagagaggaaacagggcattccttagtgggaaaacataagatgccacgggcagtctaaatgtcaagatttggactgctggtctaaaaggtttccactctctgggttgctctagtgaagcaaataaatagagtaacacatcgatcctcccacaggtagaaggctctgctgttcgttgttttactactctgcagataggcagcagcagcagcagaatttgttagcaaggatcagtctgagtcgcctatgtttactaaggaatctgtccaaattggccgtgcctttgatggatattgttattcccccataacgctgtccttaggatcctggtaaatctcagaaatctctatacaaagttaccgtttcagagcaatgaatgtgggcaaaggtgaaaatcattatgaagcagagagtggagattattaacaggtggtcgaaagagagagcgagagaaagggggagagagatagagttgctttgttgcgcaataacatgaagataaaacagttaaacacatatatcctgtttcccccagtacaagcctaatgttgctgatttcaggttcctgtgacatcattcatttactgcacctattatattacaatgggggtaaaagaagcactttccattttcatgacagaagaaatgaaacagcaccagcattaacaatagcatactgggcactgtatctgttctccttggttctggaaaggtcctagagatttatgagtaaattggaccattccaactataggcattaaagttctggtgtttccaaaccacgttggctcttggggtccattatacctggttttatgatgtttaaaaatccaatatcatttggtaagaagtaacacaacattatgtctgcaatcatgagctctagaaccactcgacttgagttgctatcccatttctactaactggtagctagctgacttttggaaaggtacttaaactttctgtgtcagtattttcttgtctttgaaatggagatgatgatgatggtgatcacggtgatggtgatagcggtgatggtgatgatgggaatagggatgatgatgatgatgatggtgatgatgaagttgatagtgataaaacccaacacataggcatgttagaaagactataaatatatgccacacccttaaacagcatctagcacgcatttaataaataggtctcattgtgattagcagaacaaatgaaagcagggcgtttctagtctcttctctggtcgtgtccctaagagaaactggaggtgcctaagaatcactggggatactagtcccagagaagagttcctggatcctgttacatgcttcctgaatctgcatagattgtatctagaaacttgcatttttgataaactctgaaaaaggttaaattttgagaattgatggatttgggcaaacgtgaaagccattctgagacagaagaagtagaggctatcaccaggtggtcctgcttaatagatagggagagacagagagctgctatgttgtttaattcagaatggcagggagctgaaacattgcctaattctgaaccagacccctgatgcttaaataggaagcccagataacacccccaattctaactgcagccatgctaactaagataacagctgtctgtattcaaagacacatatatctgtgctttgttgactagtgcctttcgtttctctggccaaagcaaatgtgcttttttggctttaattttgtgcttttcactaattaagttgtttatatgaactaaaatatttatacacccaagataatgaaaataacccatgataaatggaacaaatggagtaaaagtaaagtagatttagtggcaccatagtttattgagcatctgtgattagattgtgttccctaggatgcttcggggagtgtaattcaatctgcagtttgaactgatgactcttcctttctgtagaggtttagagaaaaaaaatgaattcttgtttttaatatctcaagtttctcttcaaatggctacttgttacatcttggggtaggaggggagtcttttaggaaaaagaagaatgggtatattttgttgccatccaggagggagactgggcagaaaattaggctatatttggtagcttataatctaggatgtgtgaagatggggtacggtgactagctgatgcaggtgaatcccagaactggggctcagcttcgaagagttcttagctttgctcaggaaagaattcaaaagtgtgctgatggaggagagccagtttactaggggaaaccgtgcacagcaatatggctgctccatagacacagcagggccaccccacaggccgagtagcactcctggattgttggctagctgtatttctagctacttatcattatatgctattaggttggtgcaaaagtaatggcagtctttgtagttaaaaaaaggtaaaaactgcattgacttttgcattaacctaataaggcgtgagttattcgcaaactttctggaaaagagggagttcccagagccattcatgatggttaatattaggtgttaacttgattggattgaaggatgcctagagagctggtgaactattgtttctgggtatgtgtgtgaaggtgttgtcagaggagataaacacctgagggagcggcctgggagagaaagacccaccctcaatctgtgttggcaccatccaatcagctgccagtacagctcgtataaagcaggtggaagaaggtgggatgagctagtttgctgagtcttccacctttcgtctttctcctgtgctggatacttcttgcccttgaccatcagcctccaggttctttagcctttggaccgctggacttaacaccagtggtttgctagaggctcttgggactttagccacagactgaaggctgcgctgtcagcttccctgcttttaaggtttcgggactcggagtgagtcattactggcttccttgctcttcagtttgcagatggcttatagtgagacttcgtcttgtgatgatgtgagtcaattctccttaataaacttcctttcatatatattaaacacatatatcctattagttctgtccctctggagaaccctaatacaccatctaagataacttctgggcattgtcatggtgtcagtaaactgtcatggtgctggtaggattgtcttatgcagatgtattatcgttcctagtcctactggtttgggccaatttctttgcgacatccagttttgatcaacagggtattgaaaacaagtcttgctgttttcctgcctcataaccatgtctgtttgcccaagactgtcccagttttagcactcagcattgaaaacccagcaccctggaaacaccttagtcctgggccaaccagacgggctggtagtaccaaaagtcagggctacctatttttgtttttcatgcaataagttaaggaagtggtttcctactctaggatagtgcttctcactctttaacagtgataggcattgcctggggatcttgctaaatgcaaattttggttcaataagtctcgggtggggtcggagcatctgcatttctaataggcttccaggtgattcaaaagccgcccttccgtgcacgctacactttaagtaacaagcttctagagggcccggtaatcacctggccggatggttaaagagcaaattcaggataccaacattttttaattctttgcaattacttttttctctccctaaaatttttgccttttaaatcactggagtaggcccgtggacgttcagtttttcctaaaaagactccttttatcttttagataaagtacaaagtaagggtctctagaaagcagtagatgacaaagtagcttttgaaactaaaatctcatgtgagtgactgtataaatagcatacaaaatggaaggatttttcattttcttctggttgtttttctatgtagttggaagttaattcacttcaagtggaaatctggaaactagtttgctatccgtcttgcccctgtttgagtatctctcaagggtatctgacaacagtgtgggaaatcaataaatgtttgttcaataaatgaaaaagtgagaatcatttaattcaatgatacttaaacttgaacatgcacaaaaatcagacggaggacttgttaaaagtgcggattgccattcagtagatctggggattgacctattaagcatttctgatatgctcctaggtgatgttgatgtcttggaacacactgtgaatggcaagaatcaagattgaacatgcaaaaaaaaaaaaaaaaaagtaacgttacatatcatgtattttgccatgcaattaaaatgctgggaagtgtgatgatgattttgtcctttagaacatataaatgggatctacagttgagagagaaccatacaaggctcttggtaatggtcaggcttatgtatttaaggtgtaattgcatctatctttatactagttcctttcccttgggaactgctcagctgaagataaataagcaaaacgggcacatgtgtagcctaatagcaaatataaagattattgagccagtttatagtgactcaataaaattctgcttgtcatgggtaagcaaaagtcagggcccttgaaatttagggtgcagcaaaaggaagcccataattggggtggaggttggggagatggccaggagactcatgtgtccatcaggagacagctaattgggcaggaaaggtgtttctggaccaaactgagggtcacactgctatttctcgtggtctaataatgaggtgcagatgaactggggaggaagagagtttttatttctgtaaccagttacagggagaaggtctggaaaatattgccagaccgactcaaaattacaaagttttccaaagattatataccttctaagttgtatgtctacatgtaagtgtgcattcatctgaagacctaagtggttcatttattgtcatctgtacctaagatctgagtcctgaggaccttcatctggaccttcagtaaatttaatctaaatgggtctaggtgctggggtgattacccttatcttgtctcgtgctaatcatggaggttgggggagttcttttagaccccgcaataaacttgtttgtggaggcctggggagtttcttcagatcccagtaaaacttgtttaatcctaaacaagtcctgttaagaaatccttcagtatcttgtcaggatttaagccccaggaaaggcctgggcacaattctgggtgggctttggttgcatcccagcctttgtagatgggctctggctgcctcagcttttattatttaacttaaccactcagtcagtgccgaaacagtagttgtggaggcctgtgttagtgagacctgatttgccacacagggtcctgttgtgcttctctgggaatttcattgcttggatgttatttgacatttcccttttaacagttaatgttagaaagtccatgttatggcctggcgcagtggctcatgcctataattccagcactttgggaggccgaggtgggcacatcacctgaggtcaggagtttgagaccagcctgaccaatttggcaaaaccctgtctctacttaaaatacaaaagttactcgggcatggtggtgcacacctgtaatcccagatacttgggagggtgaggcaggagaatcgcttgaacctgggtggccgagattgcagtgagttgagattgtgctactgtactccagcctgggtggcagtgagactccgtctcaattaaaaacaaaaaaagtgcatgttatttgatggtttttatattcctttattcatttcggcaaaagccattcccccacgttgttgtaagaatctgattgttagatgatactcttgaagtaggctgacccaaaatatttttcggagacttggctatgaagaattttataaactaacttaagttgcctttcttttaaggagctgacatagtggaattgtgcaaagaagttattttagtttcccttagggttaaatatttattgaagagggaagatggcttcttccacaacaatttttattttctccttttctaatctgttctaaaagtcttttagctgccttgctactaggaaaagggacttactcatttccattgaactcaaaatgttactttgtgtgtgtgtttaatttccccatcacccactctgcagactcaaaacctctgagctagaccatgccttgattttttttttcttttaaatgccatgagttagacatttaaggacaccaaatgattgaaaatagtcgaaaatgttcacttgaccctcattgcctatgacattgctgttagctttctgcatgaaagtgcaaacttcaattttcaggaaggcccacatcccagaactggcattgtttccttagtcattggaagcagaaaactacagcagaagtgttgcctccagccgtacagagaagaacaatctgcaggcacaatctggaaacctttcccagtgaagggagaaagtgagagtggcgttctggccttggaaaaacaaacatttgttattactttcctagggactgaaatttttagctccccagtgcaatctgtgtataatctagatttccagatttcctaaatggaaaacagataaacaaaaatcagccttcttaaattatgtatggtggtaaaataaagtaactgagaaggaaacaggattcctaaaccgaatggactttagcaaaagaatctttcaccattaataatttctccctgaacaaatatgcagatattttaccagacagagaatagagactttgttttggcttatcttgcttaagagtaattctgagaatctattacttgtgagagaataagattcataaggaatgttcgttagagagttgtactgggagattcacaggctacatttctaattttttcctaaagaactccttttacaataaaaaaccatgctgtaagctgcagagtgttgctgaaatgtaagcttttaccattgttgtagatctggcatcttgtttagaacccatagtttcctaatatttgcacgttataacatatgaagctaaactgtatagtacataaaactcatacaattttttttttttcgagatggagtcttgcactgtcaccctggctagagtgcaatgacatgatctcagctcgctgcaacctctgcctcctgggttcaagtgattctccttgcctcaggcatccaagtagctgggattacaggtgcccgccaccatgcccagctaacttgtttgtatttttagtagagatggggtttcactttgttggccaggctggactcaaactcctgacctcttgatccgcccacctcagcctcccaaagtcctgggattacaggcatgagccacccagccctgccaatacatacaaattttaactccagggtaaattgataagacttcttccttcatggaagttaaattctaataggatccctaatgccccatctagccctgcagtatttcaggtcaacaataactctttgctgactgaagatttgactggatggtacacgccctccaatggaactaacaggctcaacagctctaggtgcataaataatcttcatcctacaaataaagaattctaaattggactctaaatattgtatgtggctactgtggaagctaggaagattgattggattaatatcaagtttcacaatgtgttctttcattaggatgtcagtaatgagaatgaactattcattagaacagccaactttctaaagaataagagtgctgacctcacacatgactggggcagaacagggtactgtttacttcatgagagccctagaatgggacgcagtggattgggggccgttccctactctattgccaagtatgtgcatttgccactctgacttcttataggtaaagtattggcagttatgtcctccatagtcaatttcattcttaaaaaggccatgtgtcccaaacattaactgaaaaacaaaaagcgagattcaaagacttctcatatgctgttggtcggagtgtaaattagttcattgtgaaaagcactgtgaaaggcaattcatcaaagatctgaaaactgaataccatttgacctaccagtcccattactgggtttatatgcagaggaatataaattattctaccataaagacccatgcacgtgaatgttcactgcagcattactcacaatagcaaagatatggaatcaacctaaaggcccagcaataacagattggctaaagaaaatgtggtacatctacaccatggaatactatgcagccataaaaaatgagatcctgtcttttgcaggaacatggatggagcttgaggccattttccttagcaaactatgacaggaacaaaaaaacaaatattgcatgttctcacttacaagtgggaattcagtgatttgaacacatggacacacagaggggaacagcagactttggggtctcctggaggatagagggtaggaggagggagaagagcagaaaaaaataacttgggtacttggcttagtacctgggtggtgaaataatctgtaccatccccataacatgagtttacctatgtaatgaacctgtacatgtacctctgagcctaaaataaaagttaaaaaaattctcacttcagttatcacattgaaaggaatacagatcatcagacaatgaagagcaaatcaaattattcctggtatctcttcgaggatgtttacaaggagggaagtctgttaatgaatgctgaaaacatgtgaaattatccttaccatcttgtccattctgcatgcctcacaatgtaccctcctttcttcaaggtttttccctccactgtaaagtctgaagtgtaacacccaagccatgtggagattttcacatcttcgctgccctgttgtcctcagcatctatctccgcctttctccttacagtcacacttggctctttccaacacgaatcactagcctttactttccctgttgtatcttctttactcattgctttagttctaaaccatagaattccaaaagccaagctggaaaaggaggagttaccttttgtgaggtgagaaggggaaaaactgtgggtattcatactcaaaatatttgctagttgcagctctataagaagtcatccagcagcttggagaagtatatggttcacaaagatgattcatccaagaaccagtttgaatatttagatgatttagagtggaattagttagaatagaaatgagtatagaattgccacaggtcacaatataagagaaaaattagcaaattaattaattggatgttgttctatagccagtatttgttttagagatttttatgaagtacttttccttcctgaaagtcattataaagctttgtagtaacctgataatgttgaatatttactttaatgtcatccaaaaaactatagagttttgaaagatggaatgagaaactggtctgtaataaggaaaaaccagaaagactgtaatacatttgcatctttttcaaattcatatgctaactagagctaacaaatgttaaataatttcagaaagtatctttgctgggcctattctgaccagtaaataaaagcatttgaatgagttcaccatcttacatggatagtctgtggagaagaaatggattttaaagagcctgaactagttcccagcaaatttgatcacatcattggttttttaaaacatgtcttttacctacacgcggtaacagatttgtattatatgcgctaaaatgataatattgatattaatgaggtgatattgtcttacatgtattaccaggggagcatctttctgttttttctccctttctttttctattttttctttgtttctttttctctttccttttcatttatatatataaataaatatataaatatatatatatatatatatttttttttttttttgagagaaagtcttgctctgttacccaggctggagtgcaatagcatgatctcagctcactgcaaactccacctcctgggttcaagtgattctcctgcctcagcctcctaagtagctgagattgcaggcacgtctcaccacgtccagctgatttttgtatttttagcagagatggggtttcagcatgattgccaggctggtcttgaactcctgacctcaagtagtatgcctgcttcagcctcccaaagtgctgggattacaggtgtaagccaccgtgcccagcctctttttttccttttaataaaacactggttacaatgtgagaaacagattggagattggacagggagaccagttaggagtctgttccagtagttcaagtgacagctgatgccctcttaaactaaggtattgagggagatgatgggaactaaacagcagattcaagagttctagggcatacaatgaagagaacttggcaataaattgataatgggaattttgagacaaggatgagtgagtccaagttgatttctgcatttagggttggttgactgaatggtggtgccattcacctggatgggaaatgctggaggaatgttggagtagcacacagggctggggtcctgagttctgcactcactaatgggactttgcttgtcctatgatattaagatgcatactatggcggagtgtggtggctcacacctgtaatcccagcactttgggagcctgaggcaggcagatcacaaggtcacgagattgagaccagcctggcgagcatggtgaaagcccatctccactaaaaataaaaaatttggctgggcatggtggcagacgcctgtaatcggagctactcgggaggctaaggcagaagaatcacttgaatccaggagatggaggttgtagtgagctaagattgtgtcactgtactccagcctggtgacagagcgagactccatctcaaaaaaagatgcttattatatatatagttctattgaatatgtatgttagtatatatatctagttctgttgaatatatattattgtgtgtgtgtgtgtgtgtatatatatatagggtataatatgcatatgtaatatatgcattatatataatatgcgtattgtaccctgtatatatatatgcatagaactatatataatatgcaaattataccttgtgtatatgtatatatactatcctatacaatagaactatatatatataatcatactcaatagaactagatatatataggatgtagcaatatgcatagaactatatataatatgcatattataccttatatatgtgtgtgtgtgtgtgtgtatatatatatatatatatatagttctattgaagtatgcactagcttccagcatgtagcctttatattctactgatgccccatcactttggaattacctcttatctttttctctcctgcctttctaatatcaccccaccactgattcccatctgattatgcctacttcactgaagcacccttgtcactcccttcaatgcctaaagtattgctttcttaagtgctatggaagcagagttccttttcttgcagtgaataaactacatcccaaggatctcaccccttgcttccccagtgaatagctctcagatggaaaataaaacagcaccattactctctgagattaagagggacaggtttgcatactcaacaaacattgtctgatggggaataactgccaaatttatcatctcagggtgttggtagttgttattttaatgtaaattttgaatagataatagattaatatgaatcttattttaccaggcagaaaaatggtatacagtgaagagtaatgcttcctccaacctctgcccccaggtaatactgttcttttctccacagacaaatacctggttatctctgggtctgggtattaactgtatctgtgtcttctcccagtcataacatacaatatctctaattcatagaaaatcactacctcttaccaagggaatacttcctgtaacacctttagcagggaacaatatcggataatcccaaagcaagatgttaacgcaaactaaatatgtcctgagaaggactctgtacttctatatttgagtccttgtggatgaactgtaacctagcttaatagacaagactgaaaacctgacttaggagtatgcacctgtaacaatagttgagtcttggccaatcccagccgccatacttcaaccacccatagactgctaagtgttcaaaaaaggcaaacaccaacctgtcaccagttcagctgtttgtgtacctcactgctgatttctgtaagtcatttccctttttctgtctatgaattttctttcaccaccttggctacgctggagtctctgaatctcatgtgattctgggggctgccttctgaatcgttcattgctcaattaaacttctttaaatttaatttggctgaagtttttctttaaccagagggaagaaataaactaatgtagattgcctctaagtgccagccactgtgccagacactttctaaaggtgcatttttaaagaattattttttaaaatttttgtggatatacacatagatgtattgatttatggggtacctgagatacaaaaatattatcttcctcatctacattgaagagctgtcattcaccccaggaggcagtgtggaataagtttctgtgcacctgagactatatcctattgtatatgaagccttcaaccaaaagtgccataaccttggtacagaattgctaccccatccgaagtccataggaacacagcatagaacaaactgaagtctgagaagttcaggtgagatacgtagagctgcagaagaggagtttttcattgtctctgaattggtctttctcagcgacagagttatttatgagatggggcaatcatagaaagcagtggcttttaaaaaacacttcagctgccaaaaatcttattccaattctctggaagagtgctgtcgtaccaagtgtaattcaccagtccggtgcctttctggaagttatgaaattggagagagttgcttttgtacaaatgaataaacaccaccaagatgagcctacccgcttgtcctgagttgagattgatatgatcagacatctagagcttgttctcctgggtgtctctctgaaaaaattctcttctctctcaccttttttttttttttctgttaataagtagacaatgctctggtctgatggggtctcaggaaggaaactggtatctatcttttcttgtcaacatttaccaacaaatatgcctcttatggacagggatagggattacggatcactctcattgtcttatgtgtgcaacttggagtggattgttagctatccagaaaatgtccatccctctttttcttggagaaattcactttttaccacattttgtgattcaaattggtctgtcactgaaattattctgaaaggttaaatgagacccatgagggccgtacaggaggcttccgtgcattttttcctctccttgtccaagtggtgaagaggtaggcacataaactaagcgtggacaatggtactttttcctgggagaaggatgactaaaaagatggcgacacaaaggtatctaattttccgttcatggcaccgttcatgagtcttgattctgtgaatgtccccatatgcccctccaaaaacctctttttttttccttaagttagccagttataggtttgtattatgagtttcatagtgctataaagagctataaagaacttcctggagactgggtattttataaaggaaagaggtttaattgacgcagttccacatggctgggaagtcctctggaaacgtacaatcacggtggaaggcaaaagggaagcaaataccttcttcacagggcagcaagagaacggagcaagagcagagagaactgcgtcataaaaccatcagatctcgccagaagtcactcactatcaggagaacagtgtgccgggaaaggtcgccatgatccaatcacaagcctccctcaacatgtggggattacggttcaagagctgatttgggtggagacggagccaaatcatatcaaggttcggttgcttccaaccatacacgtaacagatatttcactaaatgctattccagaacggatttacacaatttttggaaatagttacagaacacacacagaaaaactgatgatgataagataccccgaaaaacacacctgggtatttctttctgggatgttgtggctgagataccttgatagaaaagccgattttgctgagtaacttctaaggcctccaattctgaaggaagaattaagtgatatgagagtttggaaaataattgaagagacctgcctttgcaggaaataatataggcaggaaaaatcaagaatgccacaaaattgagtaaaagagaacaaaagaagagaaatagaattacctctcaactttgtaaaatagaattgaacccagtaatactggataagatttaaaaatattatggggtaggatcacttctattaaatgtgattagcttttagctagataacattgaatattttaatgtttcattggctattatacaatatatttttttcctctatgaatattgtaaaattcctgtttgatttaggagtcagggatgtttaagtgattatgtagctagtcctcagaccacagttaaaaaggtacttttgttttgttttctggcgttgggaagattagcaacctgggtgctagcatggaaaaggcacaggaggccagttacggtgcctcaggtctgtaatcctagcactttgggaggctaaggcgggtagatcatctgaagtcaggagtttaagactagcctggccaatatggtgaaatcccatctcttcaaaaatacagaaattagctgggcgtggtagtgcacgcctgtaatcccaactactggggaggctgaggcaggagaatcgcttgaacctgggaggcagaggttacagtgagccgagattgtgccattgcactcgagcctgggcaacacgagtgaaactccatctcaaaatataaataaataaaatacaaaatataaggcacagaaaaaaatactgaaataagttgcagactggaatttcttacagatgttgtttctcctcagcatgaacagaggtggccatgccatttctccagataaatagtgcagtacaagagtgttggttggtttcatgtatcaccatataaagttgtattatcagactccatatgatgaagaagccttcacgagaaactcactaccaaagcaaaatcgttttaaattaatgaatgattttcaagtaaaggccccataggattttttatttgtcctcctgttagaatgaatatctgtgaatattaagctcctcacatttcctgttttgttaagaaatttgttcaaaatgaaagtatctccctttagaccaagctaggacggtctactaacagaaccttagaaaggaaacacaatgcaaagtgccaattagcactgcaaagttttggttcagtttcttattttttattttttttgagacggagtctgggtcttgtcacccaggctggagtgcagtggcccgatctcggctcattgcaacctccacctctagggttcaagtgattctcttgccatagcctactgagtagctgggattacaggcacatgacaccacgcccagctaattttttttgtatttttattagagacagggtttcagcgtgttggccagactggtctcaaactcctgacctcaattgatccacccgcctcagcctaccacagtgctgggattacaggcgtgagctaccacgcctggccttggttcagtttttaatgcctaaatgtggtctaaatcttttaggacaagtgtggcctcatgcaacatggattgttggaggcctcatttgtgctcataagcggcattttccttgtggacctcctgttttactccattaggttttgcatacagcagtaccatagaagatggagcacttagaaatggtgggaagcccctgagtcctttgtccatcatgtcagagtgacgatgtttctagaggtcattgctgtctttctttggagactgggagaatagggaagtaaaggaagatgtttaaattccctacttctctcttttttgttagatttttaaataaaactttatttcacaaaagacctattgtcatggcaaccagtcaaacaatgctgatgtatatgaagaaaaccatgaatatattttcactcccattaaaaaaaaaaagtgcaacctaagttttcaggcctcacctttgtatggttaaatatcaggccacaatgacttcctataacaaaattgtgattatagcaaggatgattggctaattactgaaatttacacttctccggttccccagatagtattccagttctttctggcagtcctcaaaacagccatattccatgaaacaaccctcttcgtttctagcctccagttgaccacattcatgtaactgccttcagaagctgctgcttgttgcaattcccatcttgagaatgctcgtatgggttcccaggtgtcacctctgaatgttctcatggctctagtttggggaccccagctccttcttaggttttcttcagagacagggccaatggctctttccccagccctatgctatgatctgtcacctggtccctaaagtagctttgcttgtgctgaatctcactaagtgtctctttcatcttctgcatccaaacctctctctccacaggtggctcaaaatcaatctgaagaactgagtagggggtggatgcaattccttttcattttgaatttctttatcacctttccaagtcccatactctctcaccctatcaaaatcttctccctctgtccctagttataaaatcaaacctcctgggcatgccaatggcagcaggcacctgcagagatgcggaggattcctgaagaatgagtgaagggaggaggcgctgttgatacccccaacccctctggcttccatctgagctcagccagccccttgttaggtaatgaagggagataatggtccagactggttacatttccttcctcaagttacccagcaaactattaaccagtccttgctactaacactctcatcatggcactggcaatatctgaggaccggttcagtgatctgcacaaagggaaattagattcaaacataacaacttgtcctggagtgaaaagcagatgtataatttctctcatttgtccctactttatttaatagcccacatagggagcttatttaaaactcctagaacaacaacacaccaaacaagccaatattctgagatctcattgcatgatcaacatgatgataataactgttttcttctttcatgtaataacacagagagaaaattgtggtgggggggagggaggaggtctaagagagtcagaaatgtccttttctgatcttcaaactgaaagcaagaaagttgattaagacatagctcctgatcatgtcctaagtgtttccatttctttctgacattgttttccatccattcttacggtaaataatctctgtgtgtcaagcctgacattgggtggtagaagcaggtgggtgaacaaggtagatgtggcttctagcttcatggggcttagagtctagtgggagacaggcattgatcaaattaataatgacaatccttagtatgtgctgtgaagggaagttacactgatgagcatgatagatgcgaatcacagagattctcaagtaaatggcagttaaggacagagctgaatgacaggtaggggacaaagaggctaagggggaagggctcctccaagcacagggagcagcatgtggaaggtcttggaaacctgaggaagtgaagtgaaaagtccttcagtctggaaccctgggggagaggtggggctagagttgaggttggatagaagcagcacatcaaggggtttgggtttatgtcctgtgagtgtttctggaaaggggtcctgatccagacgccaagagagggttcttggaccttgcacagaaaagaatttggggcgagtccatagagtaaaatgaaagcaagttttttaagaaaatacaggaataaaagaatggctgttctacaggcagagcagtggtatgggccgcccagctgctcatccttatcattacttcttgattatatgctaaacaagggatggattattcatagtttttcccggaaagcggtaggcaatgactagaactgagggtttctccccatttccgaccatatagcgtaacttccgggtgttgctacagcatttgtaaactgtcatggcgctggtgagagtgctgttgagcatgcaagtgctttataattagcatatagtgaagagtgaggatgaccagagatcactctcattgccatcttggttttggtgggttttggccgacttctttgccacttgctattttattttctaggtctttgtgccccgtattgtgtgctgaactcctgtctcatcctgtgactaagattgcctaaccttctgggaatgcagcccagtagatctcagccttactttacctaaccccttttcaagatggagtcactctggttcaaacacctctgacattcgcagtggaatccattaaaagatgttaaggagatatgattatatttctaaattgtcactccagcatcccctacgccagacattatgccagtctctatccatacagtatctcatttaatcctcccgtcattaatctcattttaccaatgagtaaacttgaagcaaatgagtgactttctcaaggctacctacttacgccttaccagggccaggattcaaacctagacttgttcagcgacagaacacacacttaaccattacccactcttctctctggtccccagcaaaaagtctatagtttgcagccaaacctcattctctaattccaactacctaatagtttgctcttaatagttactttaagaggaaaagcttaattctcacaacatttgtcaacactcagtctgtttgaatgggtataatttaaaaaataatttacttccactgaaggaaagaaaggactgtcttgagaagtaagaaacttgaagatctttaagagtattaatattaaggttggcaaatcctttgagaagagtttctttctgcctattgtaccatttaaaaataatcggccaggagcaatggctcatgcgtgtcccagcacttttggaggctgaggcaggaggattgcttgagctgaggagttcgagaccagcctgtgcaacatgaggagaccccgtctctacaaaatttttatttttaattaggtaggtgtggtgatgctcacttgtaatcccagctcctttggagactgaggtgaggattgcttcagtactggagttcaagaccgtagtaagctatgatcacactattgcactcgcacttgagccacagggtaagaccttgttgcaatcaatcattcagtcaacaatcattgtgtcatgtctgcctgcctgttgaaaaagccttttagatgaaagtcaatcttcggttttgttgttgccagactggccccttcatgtaattttttttttttttttttaaagaaacagggtcttgttggccgggtgtggtggcttatgcctgtaatctcagtactttgggaagccaaggcggacagatcacaggatcaggagatgaagaccatcctggctaacacagtgaaaccccgtctctactaaaaatacaaaaattagccaggcgtggtggcgggcacctgtagtcccagctgcttgggaggctgaggcaggagaatggcgtgaacccgggaggtggagcttgcagtgagctgagactgcaccactgcactccagcctgggtgacagagcaagactgtctcaaaaaaaaaaaaaaaaggaagaaaagaaacagggtgttgttctgttacccaggttggactgcagtgatgcaatcatatctcactgcagtctcaaactcctgggctcaaacagtcctcccacttcaccctcccaagtagttgggactaaaggtaaataccaccatgcctagctgttttttttgtattttttggagagatggggtcttaactgagttgcccagggtggtctcatactcctgtgctcaagcgatcccactgcctctgcctcccaaagtgctgagatggcaggtgcgagtcaccatgctcagcctctttgacataatttttgcaaatcaatgaattggacttgacatctaggtgactgtggatacagaactgatgtattaacctttgacatggctgcaacctgctgagtaaaggctgatcccttgactggacctgttatacatcactgtccacttgattaggtgcaaggaactttgttgcagagattttaaagtggaatcagacacccaggtaacatacttctgaccaccttaatgtgtcatagcttcaaacacatttaaccaaagcccctctcccatgtacgaggaccctgcttacctgttagctgcgtgtgtcacccttctttagtgtctcatggtagaaataattcagttttaaaattaacttttagctggacgcagtggctcatgcctgtaatcccaacgctttgtgaggcagaggcaggcagattggttgaggtcaagagttcgagaccagcctggccagcatggtgaaaccctttctttgcttaaaaaaaaaaaaaaaaaaaaaaatttaactggatttggtggcgcatgcgtgtaattgcagctactcgggaggctgaggcaagagaatcacttgaacccaggaggaggttgcagtgagctgagattgcaccactgcactccagcctgggcgacagagccaaactctgtctcaaagaaaaaaaaaacaaacaaaaaaaactaccaacagtctacatgaaggttgtgtgtgttaagtacatctgttaaacttctaagtttctgacaaaaaccttattaactataactcaagaattcatgaagtcccctgtgaatgtgactcatatcagacaggagatcccaagcccttcatgaaggcttgcctcataccctgttcctgggccattgcccaaaaatctactgtgtctctctgttgggcttcagaatgagatgatctggttttaaacgcaggcctgccatcctcaagctaaatgagcatgggttagtggctaaactttttgtgtctgctctcctatatctcacatgggcataaaactatcttagatgtcatgatgtaattgcattattgtttcagattttccacccctccctctatggaagcccttttctaggttcctctggtagagtaccaggcatatggcttcctgccacagggatcctgctgttggtcctgtgacagtttggccaacgaaatgttagcagacatgatacaagcagaggctttagaagtaggtgcttgtgtagctggattcacctgtgtgtgcgtctttcattactatgagaatcatggtttctaaatgggtgtgacatacggagctcacctcacccatcccacaagtgggacttaaaccaagtttagaagaaatgaacttcatctgacgtacagatccatgagtggccaaaaagaaaaaaaaaatattattgaatgccagtgagagttttatgagtgagtaaatgccagtgaggtttgttatgtagttactaaagtggcaataatacaagctgttgtaagatttaaactctagttcccttttttcttctaaagttgctatggcactctcatttaacctctagtagggcatgtatcactcagcacctgtgatgaatagctgctattattcatttttccccccttcttctggtaaagccccttagtgtttctctagagaagtcctctcttccaccctcagtctgtgtcatcagatagaaaaagccccaagcttcacaagggggagtgtgatcgaggcctggccactgatgccatttcatcctcctggcctccctgactggtccgtgcctgggcatatcgcccaactcagtccaatgagattaaatctcaggaatttacatggaattctttggaaagagactcgatttcctctgggcatgctgaactgatagaatgaagtcgaaattttggtagccacctctccatgggttgaaaggcacctgtctgagaatcaaacttgacacagaggaaaataaaggtaagtaacagagatggactatcaacggcattgtataagcgacttgaatgagttctgtctgaatccaaacaccacagacttccggtttcaggatccaacaatttccatgtgggctatggcagtttgtatcatatatttgacccctgtgagccttgtacactggagtgtcctaacattctgtttatttccgtatagaaatcgtcttcattcctgtggttggcaatcctgcatcatttaactttgtgtctcccagtggaaatggcatagtcccttgtacatagcaggtgctcacttaggtttgaattattgcttagatgaataaataatattggtctacagtgaacacacacacacatcctttaacatggctgtagagtttaagttgcaaaaggtcatcttcagaaaccaaaaggtaggccgggcatggtggctgaggccagtacttagggaggcccaggcgggcggatcacctgaggtcgggagtttgagaccagcctgaccagcatggagaaaacccatctctactaaaaatacaaaattagccgggcctgttggcgtgtatgcctgtaatcccagctactcgggaggctgaggcaggagaattgcttgaacctgggaagcggaggttgcagtgagccaggatcaaggcattgcattccagcctgggcaacaagagtgaaactctgactcaaaaaaaaaaaaaaaaaaaaaaaaaataacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagctctgcacatcagggagactgttcctgcagaggtgatgtcatctggtattttcactcatcctctggctgtgtccccacccaaatcacatcttgaattgtagttcccataatccccatatgtcatgggaggcacccaataggaagtaaaattgaatcgtggggcttgatttttcctttccttttctcataatagtgagtaagtctcatgaaatctgatggttttataaaggacacactgtctcttgcctgccgccatataagacatacctttgcttctccttcaccttccatcgtgattgtgaggcctccccagccatgtgcaactgtgagtcgattaaaccttttcttctttataaattgtccagtctcaggtatttcttcatagcattatgaaaatagactaatacgtcctcttaatcatcaaataatcttttgattccctaatggatagataggattgttcaggtaactgtgataggcccaacacagtggctcctataatcccagcattttgggaggctggggaggaaaaatcagttgaggccaggagttcgacaccagcatgggaaagatagaaaaaccgtctctacagaaaaagtttttaaaaagtaactgggtatggtggcgtgcacctatagtctcagctacttgggatggtgaggcaggaagattttttgagcccgggagttagaggctgctgcaagccatgatcacactactacagtccagcctgagtgacagagcaagaccctgtctccaaaaaaaaaacaagcaaaacaaacaaacaaaaaccgaaaactgcagtgcattctcattcttagaagattttttaagagcctctataggcctcaaatcgatgctaagtcagagacttattactgcaaaaggcctgtgaatgagcacagataaatggaccattggtacttccaaagaagccatgtagaagttaattatttttgacccatagtgttgctgtttttcatcctttgtcatccttagcagtttggaccatacatttcatgcacaatggttgaatgataattaaagctaccagttattgaatttgtattatgtgttatatacagttacttgtaagggagtcttagggttattatcacttaattcttaaccctacaaaacagattcctatatatttccagtgtgagaaacacatctcagaaatgttaaagtatcaagccactacaccattaaaaaacaatagtgatgagattcagtgccaggtttatctgcccatgttcatgatctctttgctggaaggcactcctggatttggctagaagtccagtcatggcctctacccttgtagctgttttaaatatggtgtctctttacatctaaccagggctatcacctgggtctgtggtgctttcctctcttccctattactaagttttgctacctgacatgttttgtccccaaattggaaaactagtctagtctttgatactgttttattttaaaaaatttcattgaggtgtattccacataactgatatcaattatttttaagtgaacaattcagtggcacatagtgcattaatgttgtgcaactaccacctttatctagttccaaaacattttcattatcccaaaaagaaatcccatgcctattaatcagatgcttttcatttctctctccccccaaccgctggtaaccactggtcggtctgtcacaatggatgtgtccgtttatgatatcttacataaatcgtacaacacgtggcctttttcatctgacttctttcagcataatgtttgcaagattaattcacatgatagcctgtatcagtgcttcatcaatttttatggctgaataatattccactgtagaaatgaaccaattttttcattgatagacatttgggttgtttccattttctagctgttgtgaatgatgctgttatgaacatgaaggtgcaggcacttgtctgttttcaatttttgtgggtatatacctaggcatgaaattgctaggtcatatggtttaaccctttgaggaaactctgtttttcacagctctagtttctgatgtgattgcctctactgtttggggatggatgatacttcgctgacataccttctacatgaccaaatagggagcatggttgtatagacttgacaagtgatcatcatactgagactactgccagtgaaatggttgcgtgtgatttttctgcagctactgggggagacagactgagaaaggatacagggaagcaaaacgggagctcgtgtgccaagtcgaggcattgtaagaggggagaatgatggatggttggatgacagtcagtttgaaatgctggtatggcagatttcccttgagtatcaatgctcagtagtcccactttctgccttttccattctatcaccattattctttgttggacatgcacattcttcaatgcctgttgactctcagccattctgtggtctgttactgtcacttgcaagaatttggctgtcaggggagatgccagcaagtcttttaaaagccactgcaaactttcattgctaacttgtaacttggaggaactttcagagaaagggttataaataaaacacatgcatcaatctgagtttcacaacaggaatgcaattccacttcgtggctagagataaaacatgtcttgccgtgcacagtgagctcttcgccgtgcttgcattttatttcccatcacaatctaagttatggcagatgaagctgctcataaggtatgaggttagacaaccccatgctaattcacttttacacgctatggtgtgtttttaaagatccaagctctgctttcttcagcaactcaggcttgaaggaagggagaggggtggaaaagaacccagaagaacctatgggacaagcgcgagtatggtctgactctccaaccaggttaagccttttgagagcaatagctgaatcttagatctctttgtgccttaaaatgcctggaacagtgattcacataaagggcatgcattaatattaacaagtgcgtgctgctgcagcagaggatagttctgataaccattagagttcatggacaaaaaacgatgatccctaacagcttctcaacgtgtagatactttgcttagtactgtatgtgcattattctgatgtcatgtttgttattggcatgtgtgttgaatacaattatttccattttacagatgggagactgagcatcagagggtcatagccattttatgaagcctgtatttgatagaagccaggaccatctcagccccaaagtgattagggagcctgtgttccttcttaagcattaagcattctacttcactgacctcttggcccatctgaaattgttttgttttcttttttttttttcttttttttccccagaaagagtcttgctctgtcaccgtggctggagtgcaatggcatgatcttgactcactgcaacctccacctcttggattcaagtgattctcctgcctcagcctcccaagtagctagtattatatatgtgcgccaccacacctggctaatttttgtatttttaatagagatggggttttgccatgttggccacgctagtctcaaactactggtctcaggtcatctgtatgcctcagtctcccaaagtgctggtattacaggagggagccactgtgtctggccaccacatgaaattcttataagggagtatattatcttcttccttccttgaatattccaccagttttcctcccttgattttgaatctccctattcttgatttcttagggtcagtggaaatcattcttcttccctttttcattcatttgttcattcattcattcaatatttaccaccaattgaaattttgaatgttaaatatcagccactgttctagttgttgcagataggaaaactaataataggagattcctacctctggggacctagccaggtaatcagagaaatagagggctctgtgctgtgggctggggttgaggggattacagattgctgcaaaaaggagcatgctggagttacacgtaagaaatcagtgtaagaaacggtgtcctggaagaggtggcatctggtccaaatcttgaaggatgggtatgagctggccccatgaatgaaagtgtggagaaagtgtagagttctccattatctggatttccatatctttgtctacaccttgtattttgtagtaatggaatggtgaagaggagtttccagaatgtaaatagttatttggctaggcgctgttgctggcgcctgtaatcccagcactttgggaggccagggcgggtggatcacctgaggtcaggagttcgagaccagtctggccaacatggcgaaactccatctccactaaaaatacaaaaattagccagatgtggtggttggtacctgtaatcccggctactcatggaggctgcggtaggagagtcacttgaaccagagaggcacaggttgcattgagctgagatcatgctacagcatgctccaatctgggcaacagagcgagattccatgtcaaagactgtaaacagttatcttactgtcaaggcaactcaagatgttctattgctttaaatagaaaatggtagtggtgttttgtagtaaattctatatttcattttttaaaaattaacatgttgagtatatctcctatttttcttaataataatcataataaatactaatacaagtctgtaagttaaaggtgtgctgttttgtcaacagattactctgaagagaaaatccattccttatcaaaagaggttcttggattcatcactcactaccttgaaataataatgtttttcttgtatatactctctgttttacttttctttgaaaaagtccaaaagctttctttaaaaacttttctggaagaaaacatttaaaaggaattaaatatatttttaaatttgtaataacatgtcaaagataatacatgtggattggaaagaaacactattaacatttcaaaagtgaaataattgaaagtggtattgttgggttcctgccatcttccctagaggcaaccattggtacatgattaagtgcatccttctacactgaggatttcttttttctttctttcttggtttttttttttttttttttttttttttttttgagacggcgtctggctctgtcacccaggctggaatgcagtggcatgatctttgctcactgcaacccctgtcaccctggttcaaacaattctcctgcctcagcctcccaagtagctaggattaacaacctcactcagcacccttggcgttgctggtcagatgatcctttcttgtgggggggctgacgtgttttgggaggctgcttagcaattaacctcactgccctctagctactagataccaatgccacaccccttccctactctagatgccaaaaatgtctgtagatattgcccatgttcccctggggacaaaaatggctggtgttgagaatcagtcttctagatatttttaaatacacacttaaaattcacgaattaacggaaaagccagagattattcagcaaggcagggatgatttgaaaagggaaaggaaaaataacgacaggaaaagggagttgtgtgtttagaacaaacaagctgagaacacaaaatgaatctcactttttgaacagtcttttgatattgaaggtccaggtacctacgcacgtgtgaagcatttttgagttccattttctcttccttttagaaactgcaacatcctctccctgggagtgggtatttattcaccgcttcactgcagaaagcaggagtcttggataggtaacacaaggaaagaacctagtagcagatgaagaggaaagggagggaggcagggcagtcgatgccagggacacgtgtaacggggtcctgaagacacgcagctaatgaaaggtaagggtggagacagaggcagcgatcctgcacaggaacttgcatcttccatccggaaggaggaatgaatatccttggggagccttctgatgtaggtggcagcaagactttaggaatcgtgtgactttaaattcaaatcctggttgtaccgcagggtgctcatcctttaacgatacgagtttccatgtctgcaaaaatgttgaaccttctttacattttgggtaggccgaccacatcgtggtgatgtgcagaggtggtccacgttcattgcccaggtcccccacgttcattgcccaggtctcccgctagctgtttatttcatcttggtcatgccgtctcacttctccctaccccagttttctcatctggagaagacaggactcatcgtcgccacgtaggttgtatgtattgagtcagtcgacgcatgtaagagcttagaacagactgagtgtggtgccttgtacctgtaatcccagcactttggggaggccgaagcgagaaaatcgtttgagtccaggagttcaagaccagcctaggcaacatggggagacccccttcttatttacagaaaaagggaggggtgcttagaacactgcctggtacatagtaaatactccagagttgctcgctgggatcattagcactcaagtaattcccatgggttgttaagaggcttagagatgagaaaataacctagaacagtgcctggtatacaataagcgttccataagtggcagtgtgggcacagtcttccgggcatacgtgcttgcgggcatgcgtgctctcacgtgctctattcctcctctctttggtccctctccctcttgacattttcctttcttttttttaaaaaccttcctttttttctttgtttgctaccagcctaagagctcaggagagaggactaaccctaagaccaggtgatttatttttctcacgctcatttctctttaataattatcatattgactctgaatttattatactacaagaatgactttatgtgaaatctcatgaatttaaacattaatgtaagataaattaattttaaattgaaatcctcaaacgcagttggatgtgtttccgtatgatgaataagaaattttccgaataaaatctgaatctctgatgttccattttttgtgcaaatggaagaaataggtgaggatatttgacaaggttaaaatatgattgcactgcaatagataggccatgctgtaaactaactttttagtctggggagaaagcagtttgggggcaggctttggtggataaaaagtgaagatttctttgcacatacttaccgagtctcttagtgtcctttaatctaacaccagtgaatataagatataccatcctaaagaggacactattttttacatttttaaaaataaatccattgtattagaggtgtgtttttttttttcttcaactactttaatctcattttctcctaaagttcttctcttcaatatgatctgcaaagggttgaaagtgctgtcctccaaaccaggcgtaagaaagtggttacagataaagcaagtaaatccattaaagaagaaatgggaagatgtgttgtgtgccttatctgacccagcattatcgctggaggggaagtgcttatagggaaggaagagaagtttggtcaattgatgcagtctcagtatgatgacagctggtgacttcctgagggttattcatcacacttcagcagggtgatgttttcaaagcctgagtgtgaccatgtcactcctctgttctccagcgctttcaaaataaaactgaaatccgtctcagagggccagtctcagagtatcccctgccagccccatccttcactgctcagcagtcacctccttccccctcctcacccttttgaggtctcttctgatccttcaggggccagcttctctccgtcccatggttgtttgcccatgctgatcccctacatggatctccggtcacctccatcactcttacctggttagtctttccctggcctttatcccaggtcagcttcgcttctgcaggaatgcctgccttgaaacctcaggtccttctgttccccctcttagagcactgggctattctcctgggaggcagtaattccagtagtaatttgcatacatttgtaagcagttttgattaatgcctgttgtttccactagactctatgctctgtaggggacaaatcttgtctgctttttgctcatcaatttttccccagcacagagctcaatactggcactggtaaacccttgagaaaatgattaaaagcctctaagatgcatgcagttatgaagaaccaacagaaggtacaggtggcatgggacagcagtcaggaagcaatttggcttaaggaggaaggccagtgactcacagatggagtctcagcacttcccttgcccgtagaagtgagaaacaatacaggtagtcacagcatagtaaaaatttcaggccaggcacagtggctcacagctgtaatcccagcactttgggaggctgatgtgggtgggtcacaaggtgaagagatcaggagcatcgtggccaacatgatgaaaccccatctctactcaaaatacaaaaattaactgggcatggtgacacaggcctttagacccagctactcaggagactgaggcaggagaatcacttgaacccaggaggaagaggttgcagtcagtcgacatcacgccattgcactccagcctggcaacagagcgagacgtgtctttaaaaaaaaaaaaaatcagatagcagtttcatatgactagaggctgtgggctgatcagatcctgaaaaaccgggcatggaccaagctggctaagaccaagtggacccaacatggtgctgaatttgacctaggattcacctaggacctcatgatgtgtttgttaacatcctaagtcactgtgacttgggatgttaatgagtgacttaccatgttaatgagcatatcacgaggtcctaggtgaccagcaccatgaattccgagaatacctacgtttggtgtaaaaatggatggcatcacaattctaagaaatttccaccctttcccaggaattttcataagtattccaccccttggctaaagaaacacataaaggtagcagccccaaatccccttaggcatggtgctctcttgagtccgcctacactccccctttcttgagtgtgtacttttcccgttgttataaatctctgtacttccactgttgcctgactcatccttgaattccttcttgagacggtgtcaagagcctggacacctgccgggatcagggtcccaccagcatttggggacctccccaagcccactagtatcagtagagtccctataggtaattgtctaataagtggaaggtgggtgtagaagtttcaagaaaccaaagaaatgtcagatgtgtcatttgacccaaaagaaaagcattttaaaggaagttaatgaaatgcagtcagaaaaaaaaaaaaaatagcataaaaggagaaatctgagaagttctacttttaggaatttaatctacataaatacatatataaggaggcaagaatatgtgaggaagtaaattcaatgtgtacacacacatacatacacagacacacatagatatatagaacgattgtaaaaggctatttgtagatttcttgggtaagttttgggtctgtccatgcaatgaaataccactcaaccattaaaaaaaaaaaaaacaaaaaaacgttaacttataggtacttagtatgacaaaataagtaccattagttaaacaaaaacaggtatttgcataatcatgtgagtaatatgaatgtattttcttttttcttttgtttttttaagacggagtctcgctctgtcacccatacggcagtgcaggggcgtgatcttggctcactacaacctccgtctcctgggttcaagagattcttctgtctcagcctcctgagtagctggaattacaggcacctgccacaacacccagctaatttttgcatttgtagtagaaataggatttcgccacgttggccaggctggtatcgaattcttgaccttaggagatctgcctgccttggcctcccaaagtgctgggattacaggtgtaaaccaccatgcccagccctttatttttattttattttttttatttttttgagatggagttttgctcttgttgcccaggctggagtgcagtggtgcagtctcagctctctgccacctccgccttctgggttcaagtgattctcatgcctcagcctcccaagtaactaggattacaggcacacaccaccaagcctggctaatttttgtatttttaatggagacaaggttttaccatgttggccaggctggtcttgaattcctgacctcaggtgatctgcccacctaagcctcccaaagtgctgggattacaggtgtgagccaccatgcctggctgaatgtattttcttaatgtgtgtgaagacatcagtatctaagaaaagattgtgcattctgatatacacaacagggaaagtctaaaataatacagaactattattcctggttagttcctaacattgtttcataagaaaatattccactttttttttccagtttatctttgaattttactaacgggaagtaataatagatcaatgaagaaaaatgtcacagggaccgtaagaggaagaccttagaaaaataagcaggataaaagcatcctctatgccaggagttctcaactgagactgttttgttcccccaggggacagctggcaatatctggaggcattctggtttgtcagaatggggtggggaaattgatgttgacatctagttggtagaggccaagggttctgctaaacataccacagtatatagaacagctcttacacaaagacttccccaagccaaaatagcaacagtgtcttggttaagaaacgttgctctatcatggttaaaatatggttctctactctttgcattctggtaattttaggaggatgacgtcctctgttgagatggtaaggggtcgagagagtcatccagataaaatcggtgttgactttacaatatctgaatcactcataaaattattcaagatagtaactctcccacctcctggtcaggttgacatttcagcaaccaggtagaattggtcatatagcctgttgtgaatccatggatattttatttaattgcgatatgtaaagttctccaaatgtggatgccatagaaccttcggatttaccatctaagccttttcccaattgatctcactctttttgctctaatcaaatgtacctcaacctccatctaaagtaaagctggatagattcatactactccattatcactaaggttcattttatttgcaagcggttttgctcattataatttcattagcatatttggaggtggggaatgagagaggagacaacacagcttagtcttaccttaaaccttggcttgacttggtcgaattttaactctattcttggctcacccaggtcttatagtccaagatgtaaatttacagaaacaacttcttggactctcctgttttttccaatgtcttattagatgatacgtattttctagattttactgagttaacatattttagttgtgttacctatgcaaaaaacaggaatactctgaaacatatttaaccacataattatacctcagcaaaccctccaaccaaatgcccattatatatcatttacttagcctaatatatttccctttttgaatataagagatttcacctctgaacattacatctaaagatgggcaactgtttaattatttgagtaactcaaaaatattttcaacaagagccagggctgtgggaagtgtcctcaaatggaagggttttaagcattttttttaatacaaagatgataacttgcaaccagttctattatttttaactctttgccccttcctccatctcttgggtttgagaagagctggatctttgggcaattatttattccatttccacatctttgggaaggagggacagtgggaagaacaagacccagcacttggggaatttttatgattatctccagctgtgaatgctagggagcatcatttatgcagtgaaagaagtaggaaaagcaatgtcttacttctgacgaagaacttacagttctctctaaaggggtggaataaaattgctattgcaaaaacgggaagatgttgctaatgggaatataccgaatggtatcactaattaaataaagtactttggaattcattgacagcctgcacttaagaatataattgcatattaatcaaccatttgtagacaaaactgaatgctatttattatgttaggataaaactttttcctgatatttcaaagcctgcgattcaactttgttcctaaattcatcttcagaaatgaatacactgtatttgtatgtgaggagcccaagtgaataaataagcaggagtttctgaagggaacaacacagtgggatttatcttgaaaagagcaattgctgacatatgtcacatgtcattaccagagagttggagacagtgttactcattatgtggttacagagtgttctaaattagagaaatggattattggtagtggatgatttccccagattgctacttaatagtgactgaggggtctgcattactcatatttgcgatgaaaatggtgccaaaacccagcagtggttgactgaaatgaaatgtaacacctattgggtattatcttgagatgctgcctaattgtatgcctcttgcttagtatgaatgtcttggggtctcaggggctgggtgcttgcagcagccgcagacggaaagtgaaggtttctaagttatttacctttttgttgcttcctgcctccttgctgccatgcctgtgcacttcagtaattactttacccactcaaaataagtttctccacttgccctttttccattactgggaagggtctatctttgcagctctctgtaactgtccctacctgtttgagctgccaggcttgtgctcctaggtgagcagcccagctactgttttcattcatttattgattaaatagttaagaatcccaactacgtatcaaagcctgtgctagaccttggttctggattgacaggcgaactagtgtatctgcatttctgcagctttcaatctctggggagacagatattaaaaatacagtcacacaaattgatatgtaactcctgctcctcatttaccactaatgttctaactcagcactagtcctacaggcctcttttctcttattcaaatatttcaggctcttttccacctcatggtctttgaactcactcctctttctggaaggctttttctgtggcactttccttttttttcaagtcttgtattttattttattttattttatttttatttatttatttactgagacggggtctttttctgtcacccagggtggagtgcagtggtaaaatctcggctcattacaacctccgcctcccagattgaagagattctcctgcctcagcctcctgagtacctgcgactataggctcccaacaccatgcctggctaattttttgtatttttagtagagacagggtttcaccatgttggttccgctgttctcaaactcctgacctcaggtgatcaacctgcctcggcttcccaaagtgttggggttacaggtgtgaaccactgctcccagcctcaagctttattttagctcccaccttctcagggagaccctccttgacttcccagactggaatgccagcctggccagctactctctgacagtctgaccgatcatttcctccactgcacttatacacctgttagtatgttgttaaagttacatgtcacagggcagagattttgtcttcctcatgtcttcccattggcacctagaattgactggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggaga[132 bp omitted]aaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactcacaagcaggtaaaaaataagggcaaatggtttttatatattgtctccaagtcattctcagaaaagatggctgaccctgaacaggttttgaggaggacagtccttctacatgggtgtagtgtgatgctcgcagtttgcagtatacaaagtacacagttgtggtaccgacagggctcgcattggagattcgacatcaccatgtgcttttgtgacttgtttcgtggttgaaaaaagcaaaatggatcccccaaggctcttcctacccagacccaaatgggcaagcggggagaaagctccctgaatgcctttacgttagatgctgttgggattcagagcaggtccccaggagggagccaatctgggtattcattccttagctgctgtaatactggcttgctaatggctaccagctctccactctccacagacctgagcttggccaaatgggaactgctttgcctataaggttatagagccctcaagagaaagccagcagtcaatgactgatcaaggtgcaaaaagaatagcccatttgtcttaaagagggtgttaaagcaaaccaaatatggcttgaaaaggactgcatacttctatatttgagttcttgtggatgagctgtcagctagcttaatagacagacaagactgaaaatctaacttaagagtatgggcctgtgggccgggcgtggtggctcacacctgtaatctcagtactttgggagtctgaggcaggcggatcacaaggtcaggagattgagaccatcctgactaacatggtgaaaccccatctctactaaaaatacaaaaaattagccaggcgcggtggcgggtgcctgtagtcccagctacttgggaggctgaggcaggagaatggcgtgaacccgggaggcggagcttgcagtgagccaagattgcgtcactgcactccagcctgggcgagagagtgagactctgtctttaaaaaaaaaaaaaaaaaaagtattcgcctgtaacaatagctgagtcttggccaatcccagcagctgaacttcaaccactcatagactgttaagtgttcaaaaactgtgttcaaataaggcaaacgctgagctgtaaccattctagctttttctgtacctcactgctgatttctatacatcacttcccttttttcgtctataaatttgttctgaccatgacatatccctggagtctctctgaatctgctgggattctgggggctgcccaactcacgaactgttcattgctcaaactcctttaagtttaatttggctgaagtttttattttaacagggacaaccaacactgcaaagcctgaaacctgtggctcaggcccaggctagactctacttaagaccacaccctggccaggcacagtggctcttgcctgtaatcccagcattttgggaggctgaggtgggtggattatgaggtcaggagttcaagatcagcctgcccaacacagtgaaaccctttctctactaaaaatacaaaaataagccaggcatggtggtgggcgcctgtaatcccagctagtcaggaggctgaggcaggagaatcgcttgaaccgaagaggcggaggttgcagtgtgccaagattgcgccgttgtactccagcctggcaacagagcaagactccatctcagagaaaaaaaaaaaaaaaaaagaaagaaaagaaaaaagaagaccacacccttgcttggccacttccctgccttacatgacttatctccacataggtgacagtgactttggatcagagtgatagtaaccagaagtggtcacgatctggtatattttgtagacctcttaggaaatgtgtacattaagagactgggtctcgtagatctcaggtggaatcttcagcctctgtctagtttttgtgggggtctggccatgcatcacagcctagaaagtgcaggaacctgggctgatttcatggttcagtacatggtttcctgggcaacctttctgccccttgacatacatggataaagtcctgttgccatagtaccctcatatgggtgtatctcatctatgccaactagagaataacctgaggactggagggctttgggtatgatttgtcagaatccaattagcaactccaattgattgatgatggctgattcgtgggtagctatgaatttgcagctcttagctattctgtctgtaaggatgaagacagtctgaaaagtggctgactgctgtatggagtactctttgctcctcctgggtgaaaagggtcgtgacttttagcagctcttcttcttatcttaacattctgaatcccgtgttctaatgcattattgagggtttgtgaagacagagcaggggccagctctgcacccaacgtccctttgctagggtcacgcagaggtaggggcacagtacatagggatgagagtatggggaaaaaagggctgtgacctcagactgcttaggaaagcaaattggcagcaaagttccagctcagccacttaatcttcacgtgtccttgggcaagtcatgtgacctctgttagcgtgttatgatggtgagaatgtgtacactaggggtctcaaacgcagatgcttacctagggccagacagttaatgttatcagtcaaacatggcccattgctggtctgaacaacctgtgccatttctagatggccatgcaggaatgtagatccaatggtgccagattttatcgttttaaagaaaatatggatattttgatttttttttttgtaaaatgggaaatctaattctcatttttggaaaacactacctgaccatgtaaagccacatctgtgactcatgggcaaccagtttgcatctttgatgtttatttttgtatcagaatccgctggtgctggctaggctcggtggctcacgcctgtaatcccagcactttgggaggacgaggtgggtggattacctgaggtcaggagttcaagaccagcctggccaacatggtgaaaacccgtctctactaaaaatatacaaattagctgagggtggtggcaggcacctgtaatcccagctacttcggaggccgagacgggagaatcgcctgaacccaggaggcggaggttgcagtgtgctgagatcaaatcactgcactccccactgggtgacagagcaagactctcgtcccccacaaaaaaggaatctgctggtgctaaccctaagcccccaggggcgtttaccatttcaaggcattctgcctcaatttccacaagtgtcttttggcctgaggtctttctggagcctctggagccccctttgcctacacagatgcttcactggaaatgtgagggaattaaagcaccctttccccagcaaccttcaatgggtaactcaggatttgctttataaataacccagttttccttgcttctcaagtgggataactcatgattaggggttggcaagtgtttacagtaaaggaccagatacagagaatattttaggatttgggtgccatatggtttctgtgataactgctccactacatccttgtagtacaacaatagccatagacaataacatatgggtgtggctgtgttccaataaaactttatttacaaaaatagtcagtgggccaggtctggccagctggccctgtactgggcctatattgcttatctgtgccataaagcaagctctacgcttattgcctgagttctgtgatgaaaataagctgttacccactatggtaactggcttggtaatgggctttctgcatagcctgttttctcctccttgttttacatctcccatccctactgtgttttctaagaaccttctttcataaaagcttcttgcatttaaaacctgttctccaagaacctttttttcatttttttgagggggaaggtagtaggggttagggtctggttcagtcacccaggctggagtgcggtagtgagatcacagttcactgcaatctcaaactcctgggctcaagtgatcctcttgcctgagtctcccaaatagctgggactacagactcactccactctgcccaactaattatttttaaaattttttgcagagacagggtctcactgtattgcccaaggctggtctccagtttctgaatctcaagcaatcctcctgccttggcctccccaagtgctgggattataggtatgagtcaccacatccagcccagaaacctttcaaacgttgttatttggctttatgtttgggagccatttgaatgtgtatttgaatcccagcctgaccagtttcctagccctgttgggttgagcaagtcccttcacctctctcctggcctcaggctcctcatctgtaattgagagaaggtctgtgctttctcagagaatagttaagaggatttaatgggataagatctgttaaactcttagcacataacctggcccatgttcaaggtccaataaatcactggctgtgatttcaactctttatgtgaaggatgcagtttatggctgtcttttaggaattggccaaaatgatgagtcagaagctcttcttattttcctgtttttcaccttgattttggagtaaggtcacccttcccacaggtagggtgtgatttaacagtctttaagagataacattatgaagacacctgggtgcctgagccttttgcatcttaatcgctctccctggtttcctaagagaaggaacagatgggagaatggagactggcttcaactggccgtatttcatccggctgagaacatatgttcttgggaaggatgtaggaacaccctgaaatagagcgaaaaagagatgtgagatgagagaaatcctcctgaaacatgaatggacttgagttcctgttgcccttccttgcagcttgctgcctcctgccttgcgtagaaggaaaactgttcctggttccagacagaatggatttaagttctgttctatcgttatctccttgggaaagctatatgacttctctgagcctcagtttgctgaaatctatttataaacgtttacttaggtggctttcttttttagctattcatctgattacattttctcttgctctttttcattttttggagatggagtcttgctctgtcgctcaagctgcagtgcagtcgtgcaatcttggctcactgcaaagtccacctcatgggttcaagcgtttctcctgcctcagccccccaagtagctgggattacaggctcaacccaccatgcccagctaatttttgtattttttaaatagagacaggctcttatcacgtttgccaggttggtctcaaactcctgacctaaagcagtccagctgccttcacctcccaaaatgttgggattacaagcatcagccaccatggcctggcctacatattctcattttcttctgcggtttgagaaggagtagaaaacaatacaaaatagaaacatgcctttcagccaggcatggtggctcatacctgtaatcccagcactttgggaggctgaggtgagaggatggcttgagctgaggcattcaagaccagcctgggcaatattatgagaccatatctgaaagaaaaacataaaataaaaattttaatttaaaacaaacaaaataaagccaggtaatggaaacaaactctgacatctttctgctacatgtccttttctttctccctttctttttttttttttttttttttttttttttgaggctgagttttactctgttgcccaggctggagtgcagtttatctcggctcactacaacctttgcctccttggttcaagcgattctcctgcctcagcctcccaagtagcttggactagaggcgcccaccaccatgcccagctaatttttgatttttagtagagacagggtttcaccatgttggccagactggtcttgaactgctgacttcaaatgatctgctcgccttggcctcccaaagtgctgggattacaagcgtgagccaccacgcctggcgttgtgtcagtcttatcagaaactccctcctccatcatttgactatgttttgaaatgttcactactccattcaacaaaaaatgcccatacaatccagaagaggaagcgtcttttctgataattttagcctaaatcctagagagatgatttgatttgtgtcatcagtcttctgtccgtctataaaccgattacagtgaccagagggacagcatcctctgactgtcaatgaggaagggagagtgggttataccatcctacgttgtgtggacgagttgggttgctgtagaatgggatagtttgagacagtttctcaaaggaagggattctcgattaagaaaagaaattcgactctatggagtgtgattcgtaaaagggagagtaaggacaaagctattgtcaaggtttctttatcctctgaaatgtaattattgactttttttaaaacatggatagggatatgtaactgatgccttcccccacccccctgaaaagtctaaggtctagaataaaagctacaaaagctaaattccaggatatagaaacaagcctataaaaagcaccttcatcaacaagaaacaggctcaatttcacaaaacaaacccataaagggagaagaaagacatgtaccagttagttttcaatcttcgctcaccttttgttccttcccttcagtgaaacaggccttgctgatgggttttactcattccatggtgtattagctggctaggggcaccataacaaaataccacaggctgggttgcgtaagcaacacagatttgttttcttacccttctggaggctggaaatctaaagccagagcattggcagggtctgtttcttcttgggcctctctccctggtttactgatgacgatcttcggggtgtgtcctcacttggcctttttttttgtgcctacgtgcatcttggatatctctttctctttttctaaaaatggcagtcaaattggattaaatccccaaccttatgacctcctttgaccttaattacctccttctaggtcctacctccacatatagtcacgttaggagttaagacttcaactaggaattttgaagggacacaattcggttctgggaattgttcattttcttctgaattttttttttctgtgtgtgtatgagcagaacatctcttcacccggacagaatgcaattccaagcccctctgttgctgaactgttctccctttaaaactgtcttcatcctcagcgtaggtagctccttccctgagtacgtttttttgttgttgttgttgttgttttttggtacagagtcttgctctgttgcccaggctggagtgcagtggtgtgttctcggctcgctgcaacgtctgcctcctgggttcaagtgattgtcctgcctcagcctcccgagtagctaggattataggcatgcgccactacgcagaggtaatttttttttttttttttttttttaagtagccatggggtttcaccatgttggccaggctggtctcaaactcctgacctcaagtgatccacctgcctcagcctcccaaagcgccgggattacaggcatgagccaccatgtccggccagcacattctttgtctttgcagaaccatgctcccctctgcatctcacagcctcatgtacacacccattgctttatcccatagaatcacagttacttgtgtggatctctgtccctctgtccacccaccacccactacccactacaccagcatgcactgagaacagggtaatgattcagcagtttggtatcctagtgcctggcacagagtagatgtttgataaatgtttgatgacctgaattggattgaagctgaacaaatagaaattgcatttggccattatttccaggcttagaaatgaatgtgtgttaggagacttatttccatagcattaagataatacaatatatatgcaggtgctgtgtgccttatgtagaagctctaaatctctctcaaggatgcagaaagaggtgaggttcaggttgagttgaagaatgaaaaaagagttgcttaggagaacaatgctgggaaagggaggagatttgcggccatgtaatatgggtaggtgaatttcacttaatattgtggcagaatgctctatcacaacagatgctaaaggactacatttccttcctcagctctttcttttttctttctttctctgtttttgtctctctttctctctttctgtttcttttcactctttctttctttctctctttttttttgacataggatcttgctctgtttctcaggctggagtgcagtggcatgatcacagctcattgcagcctcaaacttctaggctccagcgatcctcccacctctgcctctcgagtaggtgggactacaggcacgtatcaccatgcccagcaattttatcttattttttgtagagacagggactccctatgttgcccaggctggtcttaaactcctggactcaacaaatcctccagcatcagcttcccaaagtgttgggattataggtgtgagccaacaggccctgcctaacttttttttcttaaccagttaagaaaaggcatgtgagtgaaagaaacgtaatagagtcacccatcttctgaggggtcagtttcagctgtctgtaggctggatactggagtcattgtcattattgtctgagggtattctggctaactctttctaccaaataaatcaccctagtataatggcttaaaacaataacgtacatttattttacttaagaatctcataatggagtcagctcacttaatcaggagcttttatatagttacatagtggctgagtctggggtggttttttactcataagtctggcctgggaagactcatagagtaggagcaggaatattggggactactaagatctctctttctctccttgtaccttgttctcatctctccatgtggttttttctcatggtgatttcagggtagtcagccttcgtaagtatagtatcacttttgcctcatggattcagtgagtcacacacaaatgtccacccagattcaaggagagactccacacttctctcttttttctctctctcttttgagatggagtctcgctctttcgcccagactggagtgcagtggcataatccaggctcactgcaacctccgcctcctgggttcaagcgattctcctgcctcagcctactgagtagctgggattacaggcatatgcaccaccatgcccagctaatttttgtatatttagtagagatggggtttcaccatgttggtcaggctggtctcgaacacctgatctcttgatgggggcatggcaacattaccaaaaagcatattaacaggaaagataattgtggccactgttgaaaaaagtggtttctcatacgtggttgatcagatacatgtacctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaagggcagttttactcttctctgtgaacatcttagtgtaatattggttttatatgctggtgcattgtattgcccatgtgacagcaatatgagagaaaattaatagtatttttcatcttttgctacaccaccactttatttatttaggtatgtatgtatttatttatttatttatttatttatttttgagagggagtttcactcttgttccccaagctggagtgcagtgccgctatcttggggctcactgcaacctccatttccctggttcaagtgattctcctgcctcagcctcctgagttgctgggattatagatgcatgccaccatgctcagctaaattttgtaattttagtagagatggggtttcaccatgttggtcaggctggtctcaaactcctgtccgcaggtgatccaaccaccttggcctcccgaagtgctgggattacagatgtgagccaccagacccggcctccatcactttttgtaatgagggtgaggacacatttttgattaagtgagttatcttccctttagtgagttaccttccctttgttttgcttatctgagtgagggccacagaggctggagttgtaaatgggacctggacagattgctaagtctgggaaaagatggaatgaggaaggatgagaatggagatgggagtaccacacaggagatcgtgcagagaggcagaggagaaggactttgctttgaagagtcaggcacaaagagctgggtgaagagagtttttagagagtcttgctaaggaatccccattcgtcatctcccacattaattattccccaaagtattttgctgctggagttcttcagtgtcaagactggactcaaggggaatgagcaggctccgctgtcttccagtgaatacttgaatttgtcaagagtaagctacatgctgggctttgtcatcgtcttctcaaagagatggtattgaagattttaatttcagagtaaacctggagtggggaaggagaattgaaacctaagggccagtgggggcagttgtacctcttgcctctggtcaggtgtgggagacagaggagtgagtggttcaaatccacagcccgtcttcccttcttgtgcctgctatttgtggctgatgttgctccagttatctattgcatcatatcaaaggcatttgctctgcttaatgcctttagaaaacaatttaatatcatcttcgatggtcttgtggtttgaccaggcacagatgggtagataccgcttggggtatctcatgtggttgcagacagagagcagctggggctggagctatccaaggatttggatgggctgggtattcaaggtgacttctttcctcatttgtctggcatctgggctagttgtgttaccaggaaggggtccagatccagaccccaagtgagagtttttggatttcacacaagaaagaattcagggcaagtctgcagagtaaagtgaaagcaagtttattaagaaaggaaagaaataaaagaataggcatattccatcggcagagcagcccaagggctgctggttgcccatgttttttggttatttattttatttttttatttttatttttatttatttatttatttatttatttatttttgagatggagtcttgctctgtcacccaggctgcagtgcagtggtgtgatctcggctcactgcaagctccgcctcccgggttcacgccattctcctgcctcagcctcccgagtagctgggactacaggtgcccaccactgcgccaggctaattttttgtatttttagtacagacggggtttcaccatgttagccaggatggtctcgatctcctgacttcgtgatctgcctcccaatgtgctgcgactcacgctcagccggttatttcttcatgatatgctaaacaaggggtggattattcatgcctccgcttgttagaccatatagggtaacttcctgacgttgccatggcatttataaactttcaccgtgctggggggagtgtagcagtggggacgatcagaggtgactctcatcaccatcttggttttggtgggttatggcatctttactgcaacctgttttatcagcaaggtctttatgacccgtatcttgtgccgacatcctgtctcatcttgtgacttagaatgccttaacctcaggggaaagtagcccagcaggtctcagcgtcattttacccagcccctattgaagatggagttgctctggttcaaacatctgtgactgttgggctgggataccttagggaaagccaggcatctctcttttcacacagcctctttgtgtagttagcctggacttcctcctagcgtgacagttgcagattagtcagagcccttaaatggcccctcccttttccatgcaggacatctgtgacctagcccgagaagtcacacagcatcacttccagcatattctcttggttacacaggaccagctcctgcatagggtgggaagggactactcaggggtgagaataccaggaggcatggttcatcgaggggccatctttggagactagctctcatggatgttaaaggcagcggcttgtgagctgcagaaatgggtgaccggattttgcacgttttttgagaagcaaggggaggggaaagttaacttaatatgggagggctgcaaaagttgaggcacagcattttttccagtaagcttggccgtctttgctgagccctgcacgatgcagccgttagcaggctgggcaatgctttgctttatgaggcaattattccaacacactctattcaaaatacacattagaacttaaccttctgaatcctcaagtagcatttttatcacccaccattagaaaagagatggagtcagcatatttccccccctttttatgatcgggtatcattaataaagcattgggcaaggaccttctcgcaattcctcgggataatttgtgacacaaaaggcgttctgtgatacaatggtctgttgacttattcaataacagaggaaacacatggattgttttaaaaaataaagccaaggaattaaacaaccaaacggaatatttcctttcaacaatgggaacgcacgctcagagtagggatgtgatgctattggctatgcataactagaaatgggaagttaatatggaatttctaattggggtcacatgctaatgaactccctcttcatgttagttttatgccgcttcagaaatcttttatcatatgcttaaaaatttatgggcagaaacattaatgaaaatgaggcgtgaattggaaatcgtgtcattatggagatgagggtggcccggcattgctgattttcaaggaggtatcttttattacctttttttgagaactgagaaatgatacaggtaaaattaatgacaaggcgtattctccatcctgacataggcagcatggttctatgtaaagttataaaagtttgattttaataagattttgaattaattataaggagaatattaatcataatggacagtcatttttcagaataaaacttcaccatctaagtaatattatagttcttaagtgcataaagataggcattttcttttttctatcggctttgtcttttcagaaattaaaatccactttttcagactacgatggattggaaagcctgggccttttcatctgtgaaatactcgctcgatttcagattgtacttaaaaagtacctctctttgctaagctcaggggacaggcagattttgtgaggccatgtttatgtggagggagccagtacagtcatattaaactttttctgtttttaatctctcagaaactattgttttcaatacatctgataaccgtcacatttgaatggattttcagaaagtcgttttgtggggtttctaagagttgtacttcacgcttatcacagcagggatgaaggcagaagttggaataaaatcttgtttctaggcctgatctcaagggagtatctttttttattttttattttttaccctctctcattctgtgtgcatttggacccaggtctcagtgagtctgtggcaaagcaggtctccctcaaggctgaacaggcaggcctctgtaacaactgttccagcactgactgagtggttacgttaaatattaaaagctgaggctgggcgtaatggctcacatctgtaatctctaaacttggggaggctgaggtaggcggatcacctgaggtcaggagttcgagaccagcctggccaacatggtgaaaccccgtttctaccaaaagtacaaaaattagccgggtgtgttggcaggcacctgtaattccagctactcgggaggctgaggcaggagaatcgcttgaacctaggaggcggacatgtagtgagctgagattgtgccattgcactctagcctgggcgacaagagcgaaactccatctcataaataaataaattaataaatgccaagaaagccagtgcccttaaacaaaggctgaaatgtaacaaaaaccccccaagagttttgcctaggcctttcctaggccttgaaacatgacaagataataaaggaattcttaacaggacccatttaggattaaacaagtgtattgggggtctgaagaaactccccaggtcttgagaaataagttttttgggtttctaaaggaactccccacacctccatgatttagcaggagacaagagaaggataatcatcccagcacctggacccatttagattaagtaaatttactgaggctgcagaggaaggtcttcaggcctcagatcttatagatgagaagttaatcacttacgtctttagacgaatgcacacttacaggtagacatatagcttagaagctgtataagctctggaaaactttctaattttaagttggtctggtgatatttcccaggccttctccctgtacccggttacaggaataaactcccttgtctcccagttctcgtgtatgttgttattgggccacgagaataagcagcctgaccctcagtttggtctgggaacaactcttcaggagtcacctctttcttgtatctgttcccctgtgcccttcttacctccttccaaactctgcagaggaggcccccgcctgccttttttcctgccttctctccttccttcctctgttctggagacaggacatactcttgcaggaccagcatctcctgtctctgacgggcccactctctgtactgtctctacctgtcaccactgcaagagggtacagaactcagactttgagctcttcaatcatcatatccctgactgtagggattggcccagggttgggtacctgacccaaacaaagtcaaagagattaaatgcctcaggtccgggtgcagtggctcacatctgtaatcccagcactttggaaggccaaggtgggcggatcacttgaggtcaggagaccagcctggccaacgtgatgaaactccatctctactgaaaatacaaaaaaaaaaaaaaaaaaaaattagctgggcatggtggccagcaactatagtccagctactcaggaggctgaggcaggagaatcacttgaatccgggaggcgggagttgcagtgagccgagatcatgccactgcattccagcctgggcaatagagactccatcacacacacccacacagacacacacacgcaaaagaaagaaagaaaaaagaaaagaaagattaaatgcatgggatagtaagctgataggatgtccctgagctgctgatggccattttctcagaacctggggagaccccaccagaggagaggagagctaagcaatgcagacagtcctggccatgcaagtggagcccctgggtccctgcgtccactccagaccgtgttcaaactgtagtaatttcccagcgctgctatagcaaatagccatgaacttggtgacttaaaacaacaaagattgttgcttttgttatcagaaaggggtcccgatcaagatcccaaaggagggttcttggaaattgcagaagaaagaatcagagcgagtccgtaaagtcaaagcaagtttattagacgagcgaagaaacaaacgaatggctactccataggcagagcagctctgagggctgctgattggctactattatggttatttcttgattatatgctaaacaaggggtgaattatgagttttctgggaaaggggtggggacttcctctggaggtgaggttccttcctcacctttagaccatatagggtagcttgtgattgtttcacggcgtttttaaattgtcatggcactagtgagagtgtcctttagcatgctaatgcgttataattaatgtataatgagcagtgagagcaaaccagaagtcactttccttgccatcctggtttgggtgggttttagctggcttcttcaccacatcctgttttatcagcagggtctttatgagctgtgtcttgtgcagaccttctgtctcatcctgtgactaagaatgtctaacctcatgggaatacagctcagtagctctcagcctcattttacccagcccctattcaagatggagttgctgtggttagaaggcctctgacactttcatgattctgaaggtcagaaatccaaaaatcaggctgtatccaggaccatatttcctctgaagtcttgataggagaatccctcctttctacttccaaatgctccttggtttatggcagaatgactccaactctgcttgtttgcacatggccttctttcctaggtgtgtgtcagacctccctctcctttctcttacaaaaagactagtcattggcccaccctaaattcaggacaatctcatcttgagatccttagcttaatgacatctgcaaagatcctacacattcataggtagcaagggttaggacttcgacttatctttttaggagataaattcaacctgctacaacctgtgcaactttttctgttacatatatgacatttcccctgataaagcagcctggtttaatatagccgcagtgtgtccctggcatcctttcttcttacttcagaagctcagaggtcaaaagcaccttaaagttcattcaattcaacctgttaacatgaggcttggagccaggagctcatgcctacctataatcccagggctttgggaggccgaggccggtagattggttgaactcaggagttcaagaccagcctgagcaacacagtgaaagtcagcctctacaaatagtaaaaaattagtcaggagcagtagcatgtgtgtgtagccccagctaccttagaaggctgaggtgaaaagatcacttgagcccaggagatggaggctgcagtgagctgtgatcatgccactgcactccagcctgggcggcagaatgagaccctgtctcatggaaaaagggaaaaaaagaaaagaaagtgagccttgggatggggtgatttgggtgggctggggtggggttgttggatcttgctttgatcgctcagcagtttgcatggcaaaggagaaaaagaatgctgactcccagccaagaatcagctctgtaaaccttggatttgaaacacagtcactgtgtgaactgcccaagtcaaatgctccaggcccaccttccctctcctttactgaggaagtccgagattcacctctgggtgcaggactctttggggttctggctggtagttgccacccaagcctagcactgctattttttttcggagtccgtcatgccataattttctgtaaagaggtagcatcaaaagcagcatttgtgttggcaaaaagctagcccatcttagggtctttcaacagtgacttttttttttgttgctcttgttgttttaaaataagtggggttctcagctttgagataatgggaatgaaatcgaacctctatttttagaattaaaacacacacacacacttgaaataaaaatgtgttgttggacttctaccaaatggttggtgacaacataagttatctcatgctgtctgaaccactggtcagtaatgagatacatgttagaggatctgatttgtttgcaaaggagtgaatgactcacttgcaatgtaaaatgtacattttggctgtgttctgtaggatttcaactataggccatcctagaaaagcaaaactgtggggatagtaaaaagatccaggggtgccagagattatgtgggagggagggatgaagaggcagagcatagaggatttatttatttattttattattattatttttttgagatggagtcttgctctgttgcccaggctggagtgcattggcgcgatctcggctcactgcaagctccacctcccgggttcatgccattctcctgcctcagcctctcgagtagctggggctacaggcgcacaccaccacgcctggctaattttttgtatttttagtagagatgggatttcactgtgttagccaagacggtgtcgatctcctgacatcatgatccacccgcctcggcctcccaaagtgctgggattacaggcgtgagccactgcgcccagccccggatttatttatttacctatttttattttcttttttcaacatgaagtcttgctctgtcacccaggctggagtgcagtggtgcattctcggctcactgcaacctccgcctcccgaatcaagcgattctcctgcctcagcctcccaagtaggtgagattacaggcatgtgccaacatgcctggctaatttttgtattttttagtagagatggggtttcaccttgttggccaggctggtctcgaactgctgatctcaagtgatgcacccccctcgacctcccaaagtggtgggattataggcatgagctgttgtgcctggcagcatagaggatttttagggcagtgaaaatactctatgtgacactgtaatggtggatctgtgtcgttatatattggtctcaacccacacaatatacaacatcaactgtgaactttaatggaaactctgctctttgggtgattgtgatgtgtcagtgtatatggttatcaactgtaacaaattgcacctctggtagggggttttgttaagggtgaagctatgcctgtgtggggccagtgagggtatatggggaatctctttatacttgctgaattttctgtgaacctaatactcctctaaaaaataacgttagtttgaagaaaataaaaatacattttgacaaactcattccttcccaggatttgcaaaagctgatatcacaaagggtgtctctgatgaggtaaggtccggaagcacttgtccctgcaattcctgttggagagcctttaagaacttctcagcagggctgtttgaaaagcttaaagctaagaaaggcctttgtctaaaagagcctggttgaaatccctgctcccagctccttgctgtgtgaccctgggcaagtcactccttaacctcctccctgacttaagccaggctaatccccatctctgcggattaaaggagataacagacgccaggcacttagcagcgagtgtggcctatcctacgtgcttcataaatgatggtggaaatgattatgattgttgctttattatctctaggttctcctccttccctggagtctgggggtggcagtgttatgtagcttcttcctaggtcatgaggtgggtttatctagactctgcctccatggttctcggggccaagggcaactgtactgctgcagattgctgtggtggtagattctgggagaggtgggtggtgtaaatcactaatgaaaaggaaagcattgctttgcactcatttgggtgtaaaaaatggagaattcaggactagaatgaccaaacataaacaaatccaatttcctttttcttttgttgtgtgtgtgtgtgtgtgtgtgtgtgtgtgtgtgtgtgtgtgtgtatgatggagtcttggtctgtttcccaggctgtagtgcagtggcgtgatctcagcttactgcagcctcccgggttcaattgattcttctgcctaaacctccccagtagctgggattacaggcgtgcgccaccatgcctggctaatttttgtatttttagtagaggcagggtttcaccatgttggccaggctggtgtcaaactccggacctcaagtgatctccccaacttggcttcccaaagtgctgagatgacaggcatgagccactgcgcctggctgacaaatccagttttcactgagttctggaaaatgtgagtccagtgactatattatctgaacttaaaaagtagatgtgattggctccaaatgggaatgataataatcatgtttattatcctggggtgctttctccatagcaagtactcacttaggtcctgttcattagtcagtcttttaatctgtactgaaataggtgctgtcgcatccatggggataaggaaactgaggcatggggggattaagttgtttgcccaaggaaatgccgggaaatagtagcagagttggcatttagcatcgggggatccagtgccaggtttttaatggattcacttagggctttggaatggggagtaaatgctcaaaatggagcgtatcatagaaaatcggagatacgttttcttatcttagaaataagaacctggactttgaaggtagtgatttttactctatcacggggttctcaaccatagactgggggcctaaaaagcacataaggcatggttccactaaaaggagacatttacgctcttgccagaggcttcctatctctctgagccagctgccttcccctctctgtcccagcttctcacatagggccacatccagggccaaggagggtaaaatgagcctcccgttgactgggcactcctgcaggcactgaggataaaatgggagtgaagggagagcaagttttggctctcagagcacacacagtctagtttgaaagaaataataagtcatggcaggacagccaggaggaaggggtacatgaccctggggggtcttccagaggtccctgggcgaggtggaggggtgagctcattctgccatccacggagcatgatcacagtagcttattaggtggcgagaggggcggacgggggaagactgagagagatggatcgagttatgcaatgtctttgagaaagaatggaagatacgttagttaaaaataaggccaatggactggagaacatggggtcacagagcaagaggcaaggtggaatgatgttgctgttaggcatgagatagtgcaagctgggctgaagtgaagcgaaattgatctaaattacacctgtgatgagaagtcactgtaactctgcctgcctctatctgtctgtctgtctatctatctatctatctatctatctatctgtctgtctgtctgtctgtctgtctgtctatctatctgtctatctatctatccatccatctatccacacatccatctatccatgtatccatctattcatctctccatccatccatccatccatccatccatccatccatccatccattggcctacctattatctatttgcctatatagacattcatccatcatctacttatacatccctcttttatttctgtatgtacctatctacttatctgtacgtgcatccaccctccatctatccatatatctatacattcatccacccatcattctatttgtctatacactcattcatccattacttatctatttaaacattcatccattcatcatctatccatgtgtttgtacattcacacatccattttctatctatacattgatccatctctccatccatcatccatttgtttatacattcatctaccatctgtctgtctgtacactcatcatttcatcatccattatccatccattatttatgtatggatctgtctatacatccatccatctaccagcagtggggttggctctcatgttccttgagcagggaagagattagagggagctgaagcctcatgggaaggccagttgaagccagttccaaaaagtaatgacatttggagctaggattaggatgggggcagtggataggataggagcagtggatagacgttatttcagaagaaaaacaggaaccctttcatttgctgaatagactgacttgcttatgtgtttctcctacacctctttacatgtcatcagcttctctagttcaccctgcccctcagtactcagtacacttcgctgttgaacagcgaagtgtgtgttcagtaattatattgctcttctaagggcctggttcaagacattgaacacggtaggtccttggtcaaatgggtcttctttaattgtttgtgcccatctgcccgtgcagctgtgggaccctggggaatgtgtgggaggcagcaggtgaccaagccctgaaactaagaatgtaaggggacagggtttagaagcaaccagacatacttcctgaagaattgggttgtcagtctgaaaaaagatgccccaaatcactgctccaattcctcccaccaactgttcagctgccccgggtgccagaaggataaaaacgctcggggagagaggttggcagttctgctgatgacagcgggaaggtgctgcctctgctcttgtaaggaagccatgtgggctcacagtgctgggaggtgcttgggtctgaccctcggatgcatgagagagccactggaatggatctgtggctctgaacttgcaaccccgcacagacaccaccgctagactcggcctcagggtgggaaccccctctccgtgggtgtcctttagctctcttttcagttcagagtgactgacaggcttttctctggttggtgcctttaactcagcaaagacccccaggcaagctgtcacttggagagaggatatttgaaaagcagcctggtgaaattagcagcgatggaaacaatgcaaacatttcatttcttttccttcttttttcttcacttatttttcctccttcatcaggcattttaatactgtctttttttcctggtctcatctcacgcagctgaaataaaagcatgctgcctgacgctatccggaccgaaaaactgaggcttctccctgctttggctgaagttctcccatagccgtttcctgagagcagtcttaaagatttagaagaggaagtctggcagggaaagtctcagaatgatgtgaaggtgtagatgatggattcctcccatcctgtcagtttcagtttgcatttacacaacgtgccaccatcccacaggactcgaggaagcccacaaggtgctggcctcccatcgagtacacatactaactcctgttctcatggcagctggcctcatctccctcctctccctcctctttgcctagtaccttgtaaagtagctgattaccttcattagctcagaatgtattaatccaggtttttttgtttttttttttttaaagaaaacctgcaggtcttctggcagctgaaggctactcttgactcttggctctgtgtcaggattcacataataagctcattagaggaaagttcccagtcccacagtgaccagattagtgggtgctcaggatgtgtactttgagggaaggaagatatctgagcaaagtcagaatgttagaatctcccactttttttctcctgtagttaatacagttcccatccgagaggtgtcaagagcacttacaggagagaccttctcctaatgcattggttaagagtactgcgtgtgaacttattcagtccacttttagctgtctgtccccaaaataggtaacttaacttctcttaactcctcactacattcccagtccttcacctgttatgtgagaatgataatgaagttcttgggaagaccttggagattatggattttaaaaatgcttaggcagttactcaacgaatcctatttagtgcggggtcaggattagggtgcattgagggaggcagtgtcatgcagtgattccatatttaacttaaaaatttggatattttgttcatgatgcatatttcacaatgaataattgtgattttgtacaacattacattcaaataaggtggccgggtgtggtggctcatgcctgtaatcccagcacttcaggaggccaacgtaggtggatcgattgagctcgggagtttgagaccacactgggcaacaaaatgagacctcgtctctacaaaaaataaaaataaaaaaaaaattagttgggcattatggtgcatgcctgtagtctcagctactcgggaggctgaggtgggaggatggcttgagtctgggaggcggaggttgcagtgagctgaaatagtgccacctcactccagcctgggtgacagagccagaccctgtctcaaataaataaaaataaggtaacgtatcttaattgctgagctctctggtgcccccttcagttgtgttgcctcatcctcgttctggccctaattctgagtgtcagccatgtgtgaaccattgtactaattgatgggtatgcaatgttgtgtcacttgagactctttcagtagtctgtcatagatttcccacatacagaaatgtcacacaataaggacacgtgttattttatgtaatataaagtccttacaagcctgggcagcatagcaagaccccatttaaaaaaaattagatgggcatggtggcatacacctgtagttccagctacttgggaggctgaggcaggaagatgatttgagcctaggggttcaagactgaagcgagctatgatggtgtcactgcattccagcctgggcaacagaacaagactctggggggaaaaaaataaaaaagaaagaaacaaaaaaccccaaaatcaaaaacccatgaaaaaccaaaaaaaaagtcttaacagaataagaaggcagggtactttcaatgacccaacaacatcatcacctagactatttctgtcctttcattttctcagtatagtggtttgacacttaggtttgtcttttctcagttgcaagacaggtagtgcagttcccttaatgtttcactgacttagtctgctcaggctgctacatcaagataccttagcctgggtaatgtatcaacaatgggagtacattgctcacagttctggaagctgggcattctaagatcagagacatcagtagattcagtgtccggtgagggctgagtctctgccttataactggtgccctggcgttgtgtcttcacatggtggaagggaaaaagcactccctcctgcctcttttggaagggcactaatcccatttgtgagggctatgacctcatgacgtaatcaccttctaaaaatcctagctcttaatactatcatgttggatattagatttcaccatatgaatttgtggggacatatacattcagaccatagccccctttaacctgaattgggtcttatgccctgtctacaaaggagactggcaaaagtgactacttggaatattcagcatcaatagaagaaagaaggctgtgctagtaagagacaactgcagtaaggctcaaagacctttgtgctgtgctgttccatttgtctgaaacacatgcacacaggtgcacgtgcatacctacccatttcctcctgcccttatttgatcatagaatgtttaacagtttccttcaacagatatttcttgagaaccatactatctaatctgtccaagacataatgatgaaaaggacacatgcgtttcctgattggatggtagttataatctagcggaggaagacagacatttgacaattgagtgggtctactaatacataggaaggaaattattgggaaaaagtatccgctatacagagattttaaaatatagaaagaggtgtgctaaaaggcagctgaattgttatggggatgggattcttctggaacaccttggggattcatatgtaagctgagataggaaagcgaggacatgtcagccacagaaacatccatggaagagcaatccaggcagcaggaacagatgactcagcctaaagtggggagtgtgtttgcttgtttggggagcagaaagggaagggtggtgtaagatgggtttggaggggttggcaggggtcccgcagtgcagagcttttcagattgcaatatgaagagagagagagagagagagttggtgtgtgtgtgtgtgtgtaccactggagaattttgagcaaaagaaatgtgttcccagtttacattattaaaagatcaccagctgttacatggaatatggtgtactgattgggggcggagaatggagtcaaacattccaattaggaagccattgcaatagtcctggatagagatgactgttgttggggttagggtgttgttagcagacctgtgggagtgtggacggattggggacatcgtggagatgtcacttaagtggagtgtccacagtcctgcttctgttgggtgtggagggcgagggaaataggattcaaggctaagagcagagaagtgtctgatggaagagtctaattccctgcagtgatccgctggtaccctttacatcagcagcctcagtggggtggtgagatgggaactggaccgacttgagatgcgggagaatgtgaatgagcatggagtccgtgccacaggcaatccctgcacgcaagttttactgtgaagtgatatagaaagaagaggggaacagagagggtcaaagacttttgtttccttaacaaagagatatattacagcatttttttcccattgtgctaaaaagcacacaacatctaaccatcttaaccatttgtaagaatatagttcagtagtgttcagtatattcacgttgttgtgatagagatcacgaaagctttttcatcctctaaatctgaaactctgtatctattaactctgtaactcccctttctccctctccccagcccctggtaactgtcattctactttttgtctctatgattgggctacgtttgctaccttgtatcggtggaattatacagcgtttctcctttcgtgactggcttatatcacttagcataatgtcctcagggttcatccatggtgtaggatgtttcttcgtttttcaaggctaagtaatattcccttatgtggaatggatacattgtatttatccattcatctgtcagtggacatttgggttgccgccacttgttggtgtctgaatagtgctgctttgaacatggggatacaaatatattgcagcagatttttatactgattggaatgttctgggagaagtggagacattgatgatgcaggagaacaagcagaaaatttcaagagcaaatgctttggggacagacaacctgagtggagggctggccttgatagagatggaggcagaggtggtctcatgcgaaagtataagtgggagactccaggggaaacacaagggaggctgggtagatttgatgtcgagtgggtaagaaaatttctgttcaaattcatatttttttcaataaaaccagagacaaggggccggatgcagtggttcatgcctgttatcacaacactttgggaggctgaagtgggtggatcacttgaggtcaggagttcgaggccaacttggccaacatggtgaaaccccatctcaactaaaaatacaaataaaaatagttagcccagcacggtggtaggcacctgtaatcccagctacttgggaggctgaggaagtagaatcagttgaacctgggaggtggaggctgcagtgagctgagattgcactactgcactccagcctgggtgacggagcaagactccattgtctaaataaattaaaaatttaaaaatagagacaaggccatcagctttgagagagtgtgtgtgtggtggtggggggcggggttggaggatatcaggggttcttccccattaatagcataaatgattaacagtaagtacttggaatcaagttgatgcattttcttatgtgccatgcagacaaaataaagctcagctttgttgtcagacaaaagcagcacttattacaatggttggcatttcagagataattcaactataagagataataacacatcagtcaatcaggaagcattcttcccagtgatatcaacagaattacatgcaagtaatagactgttgtggacccaactaggaattttcttttgctgaaatgctcctatttctaggagaagctcaacgttgatttttcagcttctgtttggagagtctgtttatttctttcttcccgaggggattgtaaatggtgaggactttttattgtttttgacagttatcaaagaaacattttttttaaagctggaccattgactgaaaaataaacccatttgggatttttcgagtaaagtgtgttgaatcatgtttgtgatactcacttttaagttttggcgagcataactgcactgtgttacccattaaccggtagtttttaatttttatttttttaagttccagggtacatgtgcaggatgtgtaggtttgttaaacaggtaaacgtgtgccatggtggtttactgtgcctgtcaagctgtcatcaacgtattaagcccagcatacattagcttttatccctaatgctcgtcccctccatctcccagcagaccccagtgtgtggtgttcccctccctgtgtccatgtgttctcattgttcagctctcacttttaagtaagaacatatagtatttggttttctgttcctgtgttagtttgctgaggataatggcttccagctgcatccatgtccctgcaaaggacatgatctcattcctttttatggctgcatagaattccgtggtgtatatgtaccacatttttttattaatccagtctatcattgctgagcatttgttttgattccatgtctttgcttaatgggggatagttgtaacccctatgaatgcagagaggcatgtggtacagtttgagttggtgtcattttagtaaataacagtccagtttgtggtgatataaatcacatttttttctttttcttttttttttttttttttttttttttgcgatagagtcttgctttgttgcccaggctggagtgcaatggtacaatctcagttcactgcaactttcgcctcccaggttcaaggaattatcctgcctcagcctcccaagtagctgagataacaggtgcgtgccaccacgcccagctaattgttgaatttttagtagagatgaggtttcatcatattggccaggctggtcttgatctcctgacctcaggtgatctgcccacctcggcctcccaaagtgctgggattacaggcgtgagtcactgcacctggcccataaatcatattctttatttgcatttctggaagaccatcaggagggtagtaacatttattaaatgtccctttccatatttttcttatctcttaactgaaactcaccagaggcaggcaccagaaaaccccctgtgtttgcaaaccttgatgaagtttgccagtcactcccttggcttgtagtccttttacttccattttactcgcattcagtgctccctggaaggtgtttctttctgcaaatagctgcgtgagaaatccagcatgtcctggaccctccctcttttaaaacacttttttaaaaggattgttctaaaagaatcttcctctgcttctgcttctaattctggaagaaagggtggagctaggtgtgttcacatggtagtactttttcttttgatccaattgtttaaaaatatatggcagaataaagaggacgggaaaacctcaacaacacctcaggagtcagagagcagaggaaggtgtttcactctgtgcagatcctggactagctctgtgggttcctgtgatggtactgaggtaaagagagtgaagcatctgcccgacgcacagaatttaagaggccaccacaatactcaaccaagaagaaatcatgtcctttttttattatttttttttttgagacagggtctcattctgtcacccaggctggagtgcagtggcacaatatcagctcactgcaatctccgactcctgggttcaagcgattctcctgcctcagcctcccaagtagctggcgttacaggcacataccaccatacccagttaatttctgtattttttagtggagatggggtttcaccatcttggccaagctggtctcaaactcctgacctcaagtgatctgcctaccttggcctcccaaagtgctgggattacaggcgtgagccactgcacctggccgcaagtgcccatatgttgatagcacctgggagaaaattgatcaggtgtgtttttcccacttgacagatgaaaagactgagccacatgatcagaatttcagcccaagttcataaatatcttcccttggaacatcaatttatgattagcactgctcatatgctcataggctgaaagttttctactcctatgacccctaaagtgtacttggtgggtaattaggagcttgctgagtgaataaagataatggtaatggtaataatagtaataaaaataaaactagctgggtatggtggtgcacacctgtaatcgcagcactttgggaggctgaggtaggtggtcacttgaggtcaggagttccagatcatgctggccaacatggtgaaaccccatctgtactaaaaaatacaaaaattagccaggcatggtggtgggcgcctgtaatctcagctatttgagaggctgagggaagtgaattgcttgaacccagtaggtggaggtttcaatgagccaagatcgtcccactgcagttcagcctgggcgacagagtgagactccgtctcaaaaaggaaaaagaaacaaacaaaaaaactagcattaactggtgctttgctatgatttctacaggagttacaagagttcttatatgagcattctaattattacataggggaaactgaggcacggggcagttaagaaactcacctgtactgagaacaagaatttgaacacaggcattctggctttagaggccacactctaaatttctcctctatccttgttctagcattcagtcctatccatgaatacatgaagcaaatatcattttcagaatccagtttccagaggcgagcatgttttatacatctgtggctattggttttgttccaggaaaggggtcctgatttagaacccaagagggggtttttagatctcacaccagaaagaatttggggtgagtccacggtgcaaactaaaaaagcaagtttattaggaaaggcaagtggtgaaagaacagctacttcatagacagagtagggcgttcccgaaagtaagaggaagaacgcatccaccctaggtacaatgtttatatatatatgatatatatatcatatatatcatacctatagcatacatatcatatagcatacatatcatatatatcatgtatcatacatatatatcatgtcatacatatatatcgtatgacatatcaatatattatatatatgatatatgagatataaatgatctagatcatatataatgtacctatcatatgatgtatatcacatatatatcacatatgtcatatccatatcacatatatggtgtatatcatatatatcacatatattgtatattatatatatcatatactatatatcatatatattaaatatcctatatcacatatcatatatatcacatgccatatattgtatatcatatgtatcatgtatcatatatatcatatatatcatatatcatgtatgagatatactttatcatatatgatctatattttatatatatatcatatatatgatctatattatcatatatatgatatatattatatatatcatatatatcatatattatcatatatagatcatatatatcacatatatatgttttatcatatatattatcatataatcatatatgatttaaaaagatcttgggcagatttgctctgctacaagggtttgtgataaaggattaattttcttaattattgtgttttgcaagaattgatattatgatctttgaagcaaaattaggaatgcctttgttctctagataccgggatatctggacactcgcaagtctggttctgtttagcaaacattatttacttgttcccttaaccatacacatctagaggccaggaatgcctgacttcctgagaatgcagcccagcaagtcccagcctcattttccagccctcactcaaaatggagtcactgtagttcgaagacctctgacaattggacacacgtctgtggttcctaactcaggacagatggatttctgtggactccaagcttccaaacggcaggcccccggctggtcatctctttagctctggcactaaccgagtgccaagcacattagcacttggtgaatattgattgaaatgaattgaaattgtgggtggaggaaggctgaataaaggccatttctctgaagaaaagaaagaaaaagaaagtcatcttatcccgtagtcagtgtggattgcaggcacctttggcttatttgcagtatcttgaaaagctgcttcccaatctggtctgagagaaacacgtgagctgaggggactctctagggagatcccaagaggaaactgcctcttccagcctccccagggaaaaaaaaaaaaaaggcaaacctcctttcccaatgtggctgaatgtgtctttgcaagacactcagcattcttgtgtgtttattttctgggtcccccaagccccgccctccctctaacctgccccgtaccccgccccccttcatgtgggtgtcaattacagctgactttgcaggctccagccctgaacacaacagccgggcatgatgccctgggccccatggcatacggcagtggaggtaattagccagccttgactgggccctcggttgcagttcgaaatgcttcttgaaaaacaagtttctagccttggagagcgtggctttgtacttgatagatgttctgaatgtctttattgtggtactatgcaagaaattgggattcttttatcccggtgctctattttgggctggtctttataattagatctaattactcatacagacgtcatgaggacaatgacagctacctcaccgaacacatgatatctggaagaatagttataagcccttggtgcatatttacttattacgttttcattacaggtaggttgtattattatctccattttacagaaagggaagctgaggttcatagaagttaaagtaactcactacagtcatagagcccctttctcctttctatattctgggtattaccaggttgggtgccttccacatattttctcttgtaatcgttttaatgtcctcatgatgattttgttgtccctttcttaccgacttggaagctgaggttttgccaatgtaatcaggatgtgataaatctcagagtaagtttggaagaaggattcgaaccccagatttgaaccccagtggcctgattctggagttcatgctctgtggctacaatacattgcctatatcgggtaacaaatgccttcaatccccttcgcgcagagctgcttcattgcatttttgccctgatgatgctttcggatgctgcagagtgcattggaagggcacagaggcctggggaccacacccatcttggtggagagccccaggctgccacctgtgctaaggcaggcaaactgttgactctttctgacatccagatacaacttctgaggagaggagataatacaaaagttattatgaaagctagagagaatctgtataaaatagcaccaatatgttcaacatgatgattatgggctcagataaaattgtaccaaaaatcagacctgaattcaaatcttagttctagtgttgatagtattcaggaagttgaaaggttatttaaatccccaagtctcagttttcccacctgtaagaggtgaataagagaaaaatacagttaaatagtaaaaaccttagaggattctatggggtcctgtctgattaaacacgcaggatataatagcattcagttgagggtagctattagctatcagtgtaattatgaaaacattagttgaacctgagcactttccattgtgcgatagacccactaaattaaagttgaagaaagtcctttgaacagaagaaattacagtgatttacagcatctgttcttcccccagtacctttctattgattgaagggctgtatgttgtagttaattaaaatgaatatcttcaattggatacagcaatgcttttgcaaaagaagagatagcaggattgcagcacagtacaggggtgtgactctttcattcacagtttggggagctcagaactttcttttgggttgcagaaataagttatgtttcaatagaattcaaataaataaacatgtgaggcgttattatgcttataaatttgaaggctgtgatcattcctcctaaacagtggatgaagattttctaaaaatgcaaaaatcatctcagtgggtattccacccttttctcctgcctacagaaatgccagatgcactcaggctggtgttgggctctgtgatgtgtttgctttgtgagcctcctgggcatctaggtgtggccacaggacaagatcttgtcaaagagatggaactgccagtttctgagaggtctctggggaagctttcattttcctgttggagtgggtaccttctaacaccgtttctccttcccagccttaatggtgtcattatagtgttaacggtggggctacagaactggatatataaccgcatggcaccttgaccctggtgttagagtgtagtagaacagtcacagcacaggctggacgtatgtcacctgagaaccttaatccctcttcaattaagcctccgcagttaggatttctattatttgcatccaaaagcaattctagctgatataacttgaaaaattaccgcaaaattttatttcctatacaaatgtgctgtgtcaggtgtgagtgtgtgcgtttatgatatgaacaatagttcttccgttaaatattacctattcgttttttgttccagatgaggactaacatgtaaccatttcttttgttttctaatcttatctttttccttcatgagagtttacttgccattttcaaacacagaaagatatgtttacaaaagcaaaaaacttgtcttcttatgttgaaatttttctggtgtttgtttgcattcctaggcccactggttatccatgaacagaaaagtgttttccaagctaacatttgacatgagaatcaaaagcgagtattgaaaaacagctttaataaaatggaggtggcaggttttagctgaaaaactccaattatcagaaggtgttggtatttctcaaggaagaacacaatacagctaaatttctgactctcccggagataatttggagggagcaatgtcatcaaaggagggcagattatatgtgggaagaaaatgttcaggaatggagcaggtacagtagctcatgcctgtaatcccagcactttgggaggccaaggcaggcggatcacttcaggtcaggagttcaaaaccagtctggctaacatgttgaaaccccatctgtactaaaaatacaaaaattagctgggcatggtggtgtgtgcttgtaatcccaattaatcgggagtctgaggcatgagaatcccttgaacctgggaagtggaggttgcagtctgccgagatcacgccactgcactccagcctgggtggcagagcaagtctcagtctcaaaaaaaaaaaaaaaaacactaaaaaattcaggagtggtgagatccagtacttttccaattaagtaaactctttttttatttttttaattttaaatttacaggtacacttgcaggtttgttgcacagataagcttgtgtgatgggggtttgtggtacagattatttcatcacccaggtattaagcctagtactcattcattgttttttgtgattctcccctcctcccaccattcaccctccaaaaggcccctgtgttttgtccccctctatgtgtccatgtgttctcattatttagctcctactttacttttctgtttctgtgttaatttgctaaggataatggcctcgaggtccatccatgtccctgcaaaggacatcatcttattcttacttttggatgcatagtattccatggtgtgtataaaccacagattctttatccagtgtattagtctgttctcatgctgctaataaagacgtacctgagactgggtaatttataaaggaagaagattaaattgactgacagttccacgtggctggggaggcctcacagtcatgatgggaggcaaaggaggagagaagtcacatcttacatagtggcaagccagagaatttgtgtagaggaactcccttttataaaaccatcttgtcacatgagagtcagtatcctgagaacagcacatgaaagaccagccctcatgattcaattatttcccgcctggttcccccaggacatgtgggaattgtcagagctaccagtcaagatgagattggggtggggacacagccaagccatatcatccagtctacactgatgacatttaagttgattccacatcttggctattgtgaatagtgctgcagtgagtatacgcatgcatgggtctttgtattacaatagaactttttattggcacatgaaaatacaaataagcctccaaatagtgtgtaatacaatttctttgaaccctcgtgttttaccttacaaatttatgtaaaattttcgtagtttttcatgatatactcatgttggtttatataacaagaatgtggcccccgcaccaatgactaaaccaaattagtgatacgaagagttatccatgtttatggtattggattgtgtattctctggcatccaatttgagaaacctgagaatggtcctgtggttggctatcaggtacccggggagaaatgtagctgctttcaatttgaaaacccttttccaggtaacaaagattgacctacattattccattttgatctttacagaaacccattcccattgttggccagcatgtcattttgacttttgttggttttattagtgagaacactgaatatcattccagagtcagggctctgatcctggagcatcagtcatgtctacttaagtcctttcattgcagcgagctccttctcattcgttcatgagagtcgttgacgaggtggatcctggagtagtctcagacggcctcgccctctgttcatcatccttttgatggaatctccctgttagtagttccaaatcatagttaccatgagttgaacagttgtttgtaccaggagctgagcaaagccctttcttgcacattgtcacattgagtattcacagtaaatgtaagaggtagatttactgttatctcattttgaaagatgtggaactggccaggtgcagtggctcatgcctgtaatcccaacactttgggaggtcgaggcaggtggatcacctgaggtcaggagttcaagaccagcctggccaacatggcggagccctgtctctactaaaaatacaaaaattagctgggcatggtggcggatgcctgtaatccaagatacttgggaggctgaggcagggagaacaacttgaacccaggaggtggaggttgcagtgagataacatcatgccattgtgctccagcctgggtgacaagagtgagactctgtctaaaaaaaaaaaaaaaaaaaaaaaaggaaaggtgtcgaactgaggctcgagcattttggtaagttatctaacatcacattactggggagtggccatgctgagacatgagttacagttttccagataccaaaactcttagctgttccattgacagcttcctagcagggatagcacaccaagcctctaccctttccttgggtagtactcatcctctgactctgtcacccgctttatcctcttggtgatggcagagctacttggaatcactagtaactgcattagaatgatgtgcagttgtctatccaatgagttttgtccattatttctttagccgtaaataaatgaggaaagtacagaattattggtggggggtggtctttgaaaaagctagggtgggagaatatcgagaatgatataattatctatttgctgcttctggtccgccgacttgctggctttttttttttttaataggattatggaagatgaaaaggaagcgcttacttcagcttataagagcaatgtaagcaattttgcattgcactcactccccaggggtggtgtgaacatgtttctagtaaattaaagtatcataaaagcattggcaacatggcaacttttatattaatttcttaatttttcgcaggcttaattataaatctcttgggagaagaggcaaggcctgtcggttcctgggaaaacagtgttgcatctctaggcttgaaggtctgctcttctgctcagaagtatgtgtgctgtgatgtaggctgggtggctgctgtaggttgcatgcactacttgtgcctagtgatggtagtgatgccctgtggacaagacattaggctgggaggcccatgcatgcagccaagtggagagagtgctcttggacaaggtgttgtgtgactcttagcatgtagtaatgtgtcataagagcacagtctctgcagtttactaagtgtaaaatcctggatctggcctggagtggtggctgaaccctgtaattccagcactttgggaggccaaggtgggcagatcacctgaggtcaggagttcaagacctgtctgatcaacatggagaaaccctgtctctactaaaaatacgaaattagccgagtatgatggcaggcgcttgtaatctcagcaacttgggaggctgaggcaggacaattgcttgaaccctggaggcagaggttgcggtgagccgagatagtgccattgcactccagcctacgcaacaagagtaaaactccatcttaaacataaaataaaataatcctggatcctcctgtactacctgtgtgacctagagaaatttgaccagccctttgatctgtgaaatatgatggtatcaatgtcacctgggatatgcatgaaaaagcctacatcctacagcactactgagcatcctcaccagcctaggggtatctccagtgagacgaaccatcaggaaaacaatatatatccctatggatgaagccactgttaggcaggttttgttacttgcagcctaaagtctcctcacctttagtagtcactaaattagaatggtgcagcagcccattgagttccggattcactgaatgatggcatatttatgctggacagaatcttagctctgcccagtgagtttaccacatgccttctttacttaatatttttattattattttgagatggagtctctgttgaccaggctggagtgcagtggtgtgatctcttctcactgcaacctctgcctcccaggttcatgaaattctcctgcctcagcctcctgagtagctaagattagaggtgcatgccaccacacctggctaatttttgtatttttagcagagatggggtttcaccatattggtcaggctggtcttgaactcctgacctcagctgatccacctgcctcagcctcccaaagtgctaggattacaggtatgagacattgcacccggtaccttctttacttacaaatctactgtaaggaaagtgaaaaatcaggagggagggctccttgaaaaacccagggggaaatatcctggctttgctggccagatcccaatgagttagttcctctggatttcatttctcaagattctggaatttcctctcccctctccttccttcccctaccctaccctaccctaccctaccctcttctttcctctgcccttctgtagcatagtatggtttaaaatgtgatcacattctattttaatcatggaaagatttttttctctggcctcttgtcttttctgggctacatgccacatattggtagggaatatatcttatgtttttacatgtccttcaattaattttgaaatattaattttatgataggttaacttatgctgcacacacatacatacacaaaagatatatggtcttataaataggtatggctggacaaggtgactcaggaggcttaggcaggaagatcacttcagcccatgtgttctcagtctagcctgggcaaaatagctagtccacatctcttaaaaaattaattaactaaagaacactatgtgtggaaaatactggattagaaagattagacagggctgggagcagtggctcacgcctgtaatcccagcactttgggaggccaaggtgggtggatcatttgaggtcaggagttagagaacagtctgaccagcgtggcaaaaccccatctctacaaaaaatacaaaaaagaaaattagccaggcatggtgtcaggtgcctataatctcagctactcaagaggctgaggcataagaattgcttgaacccaggaggcagaggttgcaatgagcttagttggtgctactgcactccggcctgggccacagagcgtgagttcatgtaaaaaaaaaaaaaaacagaatttttttttcttttttctttttcttttctttttttgcaggacttctttgtatctttaatctgcaaatgaatgtgaattgtaaatctccatggagtgatatagaataaggcactttccaaacttaccggacgagagaaattttttttcataaaacatcttgcagaaactcactttagagaacctgcatatctccaatttttaaatttcatttgtctttttaaaaatgtgcaatattttttcaactttttattttgaaaaattctaaacatgaaaaaatgtaagacttgtacaataacccttatatacgtctaccagaatcaccaatttctatttttatttatttatttatttatttatttattttctgagacagagtcttggtctgtcacccaggctggagtgcaatggcatgatcttggctcactgcaacctgtgcctcccgggttcaagcgactcttgcctcagcctcccgagtagctgggattgcaggcgtctgccaccatgtctggctaattttcctgtttctagtagagacggggtttcaccatgttggccaggctggtctggaactcctgacctcaagtgatccccctgcctcagcctcccaaagtgctggtattacaggcgtgagccaccacgtccagccccaggctggttttgaactcatgggctcaactgattcacctgccttggcttcccaaagtgctgggattgtaggcatgagctcctgggcctggcccagaatcaccagtttttaatattaaatattttttactgcatttgctcatcctctgtctccctcttttccttcccttcctctccctccccttctctctctccttctctctgtctttttgcaaattcttgatgggtatcttttcgtgacaagaaagaaggtggtctggatgccagttgcctcctccacttgcctttaagaaaataactgaacacgctgtagggcaggtgcctgtatgtttcacttgtcttggttgatgatttattataatcccatcttagaatcctagaatctcaagttgcagagggacctgaaaggttatctaatccaccccttgctcacctgcccaccccgcctgcattccctacccatgctttcgaatgccatttattgtgtttgccagggtttgttggttagtccattctgagtggaatgaaacttgcaaataaggccttgtggagagcctgccctcttcctgggcatcatccaagcgatctattagcagcttccatttatcagcgtcttgtgtgggtgtagtgggcctaataatgggagctcagtcagagagcagcattttgatagaggactgaagtgttttgccaagtcttgattacccataataacaagaatgaaaactttggccctggttatgcacagatttattgaatcatggaatattcatgctggatggaatcttaggatcatctggttcagtccctgaagttttcaaaggaggaagtgagtggagaacaagagagaatgagtagtttgcctaaaatctcatcactaccatggtttctgattccaggcccaggttatctcccgagccactaggcttatctcaggacagcaacagaaaacttttcagacacacacacacacacacacacacacacacacacacacacacacacacagaggcatgccccacacattgcaaacataatcatatacacgggcacatctatacataagcataggtgggcacaggtgcacaaacttacctgcaatctcattcataaatggaatttccattccgttgaaatatagctcatgactggggcctccactgacctgcagttcacaatctagaagtgtgaacttggaaatagaaactcatccaaatacatgaccacagtttattcacctgtgtggtgcctcttgcagatagcagaggggaggagaataagaacgaacattgtaaggctgttgggatgactggtccgtggagtgacagaagagattagaaatccaggtttattgggagggcatctcaaagcagccacattttatccctattcgggtcagaaatgaaatgtttatgatggctggaatgagatcccacaggaaacttgagtttactaagtgccagctaggcagtctttccttgcataatcttatatagtcgtcatcatggttatgtttctggtgaaaaaaaaattagatatggaaatgctattagttaccccacattccacagccagtaaatggtaaaaccaagaatcaaatgtggatccagagagcactgagaacataggaatacataaaaaagaaaacgcatttcaaagagaaacacagcagagttttagaagtgtcctaatggtaaatctccccctaaatttttggaaacaaatttgcattttcctgctggtttttccaggcaggactttctcctctcagcaaagccctatagacctttagagcagtgtagtctattggagtttcctgtgatgatgaaagtgtttataatcttactgtccactgtagtagctactgtttacttatggttattgagtgagttaagatatatgctggatttcaaagacttagtatatgaaagtgttttaaatagctcattgagagtttttaaaaagtcgattgcctgttgtgataacatattgggctaaatatatttttaaaattagtcttacctgttttattttttcttttccctttttattttaatttaactttatttaattttattttattttatttatttgggaccgagtcttgctctgtcccctaggctggagtgcagtggtgcgatctcggctcactacaacctctgcctcagcctcagcctcagccttagcctcctgagcagctgggattacaggtgtgtgacatcacacccagctaatttttttttttgtttgtttgttttttgttttttgttttttgttttttgtttttgtttttaagatggagtcttgctcattgcccaggctggagtgcaatggcataatctcggctcactgcatcctctccctcctgggttcagtgattctccctgccttagcctcctaagtagctgggattacaggcgcccactaccatgcctggctaatttttagttgagatgggttttcccatgttggctaggctgctcttgaactcctggcctgaggtgatccacccccctcggactcccaaagtgctgggattataagcgtgagccaccgcgcccggcttttttggtatttttagtagagacgggatttcgccatgttgggcaggttggcctaaactcttgacctcaagtgatctgcccgcctcagccttccatagtgctgggatttcaggcctgagccactgtgcttggcctctttttccgttttaaaatgtggctattagaaaaattttaattgcatgtattgcttgcattatttttctcttgggcagtatggatctggataatttgtctatgaagatatatttacaattatatgtgcttctctctgtctatctgtatcagtctgtcttttgaaggacattttattaaacagcattatatagtgtataatgaattacaatttgttattatttaacggtgcaattagaactttttttccccacatattggtacctgtaagttaatatcatcctctgtaattattatatagcaatctttagataaactgatttattagttgcctatcaatttatacgtagtaccagggatggatataaagaatagaaacaggtacagctgtggagaatgcaaccatttaagagtgggacagaagttatctctgcagactgtctggagaataaagaaacaaaggaacagaagctacttggaacagaggtgttgatggaaatgaagaaatagaagtccctaaaaggggtcaggtgctgtggctcacacctgtaattccagcactttgggaggctaaggcaggtggatcacctgaggtcaggatttcgaaactagcctggctaacatggtgaaattccatctctactaaaaatacaaacattagccaggcctggtgatgggcaccgtataatcccagctactcgggagtctgagacgggagaattgcttgaattcaggaggcagaagttgcagtgaactgagaccgcaccaccgcactccagcctgggtgacaagagcgagactctgtttcacacaaaaaactgagaaaatgtctgcaaactacttgaaatatgatttagctcccctgtactagaatatactcttcaagaggtcagatactgcttgtttttatgtgaacatatgtcaccaacaactagtaaacgtgcccaacacacagtagggattcagtaagtatgtgttgaagaaatgaatggaatggcaactctcaattttggatttctttgcttcgcattttaaaaattctgatagtggccagatagcggtagctcacggctgtaatcccagtactttgggaggccgaggcgggtgggtcacctgaggtcaggagttcgagaccagcctggccaacatggtgaaaccccatttctactaaaaatacaaaagttagccggtagtggtggcgcatgcctgtaatcccagctattcaggagtcggaggcaggagaatcgcttgaacctgggagttggagtttgcagtgagttgagatctcgccactgcattcccacctgggcaacaagaaagaaactccatctcaaaaaaataaaaattctgttagtattcacatagaaggatgatactgtgtcccataaaatatatccaagtttaccaagtagaagtagcatatattacattggtgcaaaagtaattgtgctttttgtcattactttcaaaggcaaaagccgtgatcagttttgcaccgacctaatagttgtgaatgtgagcttggacaagtttcttaagcttactggtcttccatgatcttccatgtccatctcaggatagttcgagcccaaactgcttgttaaggtccaggaagctgatacatatcagtgagtgctgataacagaaaaccatgctatgtctagttgctaattttttaagataagataaggctgtcattttttatgatagaaaagtgactctcgcaatttattgccaatgagaaccaccacattgttcattgattgcatattttaaagctctgtgtccagatattctaatttactacatcacagttggctatttctggccaggcgtggtggctcacacctgtaattccagtacgttgggaggccaaggtgggtggcctgcttcagcacagaagttcgaggccatcctaggcaacgtaataaaattgtctctccaaaaaaaaaaaaaaaaaaaaaaaaaagacacggtggcgtgtacctttagttccagttacagaatgaggcaggagaattacttgagcctgggaggcagaggttgcagtgagttgagaccatgccacgtcactccagcctgggcagtagagtgagaccttgtctcaaaacaaaagttggctatttctgcatttctccatttcagctaatacatctgtatgtacaggccctggacaggatgcctgggagacattaataagcaacattccgtttgggcctcaggaagctcatatcccataggggaactgacacaatgattagcacaaatacgtagataagtccttttgaaaaatgaattcccatgtgattattatcatcaacccacttctcaaatgttttttctttttgttgttgttgttttgagatggggtcccactctgtcacccaggctggagttcagtggtgcaatctcagctcactgcaacttccacctcccaggctcaagccatcctcctacctcagctgtccaagtagctgggaccacaggcttgtgctgccattcctgcctgacttttgtagttttggtagaggtggggtttcaccatgttgcccaggctggtcttgaactcctgagcccaagcaatctgcctgcttaggccttccaaagtgctgctaggattacaggtgtgacccaccaggcccagcccacttctgaaatgttaatgtgcataggaatcacttcagggttttgtatcaaattcagtttcttagatcctacccacagagtttctgattcaatcaatagggtggtgggggtgtcccagatcctgtgttgttaacaggactccctgtgtttcagaagctggtgctatgaaaactacaccttgaaaactattgtcagagtgtggtccacctctagaaaatattggcctgtctttgccagagtttcacccattccttagggagaacgggtgtagctgtctcttcctttccagtctgtgtaggaagcagaaccaagctcatagagaagcaattttttgttttttttgagatggagtctcactctgttgcacaggctggagtgcagtggtgcaatctcggcttactgcagcctctgcctcccggattcaagggattttcctggtgcaatctcggctcattgcagcctctgcctcccaggttcaagcaattctcctgcctcagctttcccagtagctgggactacaggtacccaccaccatgcccagctaatttttgtatttttagtagagacggggtttcaccatgttggccaggctggtcttgaactcttgatctcacgtgatctgccttggcctcccaaagtgctgggattacaggcgtgagctactgcatccagcctagcaattccttaagtaccttgttcatcccttccaaggtcagcttgggttcctcagtagtcgtggtatttctctgtggtgtaaaatgcacataaaggacttaaaaactaggtaagaaggcagttaaggataaaagttacacaacttcaaccatattctgttagagccacaaagggcttcagaaaccagctaatgattttagagaaaagatggcatgagtccaagaggtcacatgatctacccaaggtcacttgtgtctagagtttttgtgtatcatgacatgaccaatggccatggcccagaaaggctgattccttccttttccaaaaaaaaaaaaaaaaagatttgtgatacttcaatatattcagtgcccaccgcccaagcacggtgtcattcacaaggaattataatggatttcattgtagaatgcagactccttcttcccaattacttctttgctttaaacataaagccgagagcctgaccctgggaatagttcttgtctgaatttctgatagattttaatttcgcagctggagcctggtcctcacagtcattccctaatttcttttgttagtctactgcattcatctttggttctgtgtaggatccatagatggactgaactgtaacactgactttcttttctttgtctcacttgtcaaataaaatcatttgaggctgaatggtattgatagctgtgcaatgacttgttgctactgtagaggggaccctgcacacaccttcctgggagtcatgtttgttgttcaaatgagtcttctgagaatcaggatctcttgaaaaagataacacatcagtagtattaaaaactaacgaatagggcaaatcctcatttagctcctttcggtaataaattcatttgcttgggttcaggatttgtagagcatattctaaatgcattgctggctgagggatccatcagagtgggaaggggagatggggaaagccatcctgttgcattgaagaaacggaatctgtgatcaggaaacctggttaaaggtcctttcccctttgtaattttattctacatagggaggcaagagtggtgctgcaacatatggagagacttgagtttaattgttaaaattccactcagccgggccacttcttcactgtgatttgcactatttagcatttgtgtgcattaggtaatatatttaatgtttctccctccaatccaatttgcgtgtgtttggcagcagcccagctccatgggcatggggcaggggagatcataaatctgccatcctggagcatggaaactgtattgctgcatttgatagtatgcttgcatgaacactccaaaatgcttgtgaagcaataccacctcttccccgaacgtctctcagggacaacattaatgtatctcatattgtattgattgtagccaataagtgcctaaatgatttggtgcaaggcagaaagattatgcagggaagaggggtggaggtggctttagaagaagtatgtggtttaattactggctgaatttcctcaatccacctccccctctgggagtttaacaaacaggccttagtgcactttagctgttgctgacatctgttgaaatgatatctgcccgtgatgaggggagtttgggaattgcgcttggggtattggcgggatcagggagccacaggaagctcctttccagtctgcaaaattagaaggaggaaaacactgcagtagtactctaaggttaagctatggagagcacagttttatctaatggaattctgccttccgacttaatgaagccatcttcatcttaaatgcagggttggatgtaagtgtctagagtctaatgatcttaaagtcccaggtgttgataacaaacacagagttgagctgaaaacatgaatagtgcatgggcaatgcttcaggcacccaattgtaaaaaccacccccagctctctctttttaatgccatgctaagaactgttaggaaacttcacagtttttaggtaaacaacaagtgaccgattttcttgcattttttaatagaagcaaaagaagccaaaacctagctaaaatttcatgttgggtccagcaccaggaagaatgatgctgtgtatctgctagtgttttgattacatcaataattcaaagaaagtgccatccacttaatctcttttatgcctctccacccgaaaggatcctggttgtattctgaaagtcctgaagctatcatattccacagctttttctgaaatgtgttattatgttatgcttgaaacatttatatatgttaccgaccaaattgcatggaaacgatttgctttcagagactgataaaaattcacttttgatggtagacacaaggtgagatgttatcaaaacaaaattccaaattaacttggatatctctatcagaacatatccctgattgggcatgtgattcttgcattattttgtgtgtgtgtgtgtgtgtgtgtgtgtgttggtcattgtatttaaaaatgtgtttgcatacgtgtgtatatggatatatatgtgccaggtattaggctggctaattattgtgactaaaactctctggggttaagtggaaaattaaaaattcagaacaaccatagtctgttatctgtcacctgtaatttaggctaatatctcaattctcttgttatggacatttctcttacagtgtggctttacataatgggaattggatgtaatgtgatcaattaattagagcatatgatttacattagtcaaacctgtattgattacaaaatgactatgatctgaaagtagccttgtgtgtgtgtgtgtgtgtgtgtgtgtgtgtgtgtgtgtgttagaagtggtgatcctgctttgtatgtggccaacttggggagggggatggatttttcactttattattgtgacgtgtgatagacctatggggtgttttaaaattcccaagcaaataatcttgctggtggtgacagaagaggaaggctttgaagaggggtgtggtggctcacgcatgtaatcccactactttgggaggccaaggagggtggatcaccttaggtcaggatcaccagcatgggcaacacactgaaaccttgtctctactaaacatacaaaaattagctggacgtggtggtgcacgcttgtaatcccagctactcagaaggctgaggcaggagaatcacttgaacctgggagcacagaggttgcagtgagccaagatcatgccaccgcactgcagcctgggccatagagtgagactccatcttaaaaaaataataataaaaaacaaaaaaagggaaaggctttgaggtaaaagctagaggtacttacacttgagattggttcagattttataactcaacagacaagtatctgattctctgcatcctcctatgtttgaaccataaatttattagaaagcatatataggaaaaaacaacccagttcctttgagtctgaaactttctagtccctaattactttttcccattggaagtatatttatagcatacaaatctaaacttctcaacttaccttgataactggtccccatgttgatggccatggggcgtcttgaagaccatcagtgatccaagtatattccattagttttcatgtcaagaacattttattgtatcctaattatctgaaacttggtcatctgaaataacatggcagttcccgataaatcattgcctttttgatttcctagccatcttgaatacaggaaggcttagtttagcctttgcttttaaattcatataaatacaatgatattgagtatctctactttagaataacactgaactagtactgggatttttaaatttgatattcggacagctctttttctgttctgtggttttgtgcatgtgtgtgtgtgcatataaacatgtatgtgtgtgcatgtataggtatctggatacacatctagatgtgtttatatctagattgatacatacatgtgtatatatatccatcctcctatctggacacgcatatttgttacttgaaaataagtagggcttgcatacattgtagttactattgtaagtgctttccaaatatttaactcatttactagcccaacgactttatgctttaggcactgtattttcatttaaccaatggggacagtgacgcacaaagaagctaattagtttgtctgaggtcacagaggtagtaagtggcaggattgggattcaattgataatgcagtgcttcatacaaataatgctttgcaatttttgagcacttttctacatgtcagatagagggatttaattttttactcatttgatttttatggccagtctatgagttgatttccatcattgctagtttgctgaatgggacacagaggctgaaagaataacacatctgtagtcacagagttagaagctgatggaactgaactttgcatccaggaaatcagactagagaatttttaataaattatcaagaaagtttataggcagcattgaagatttcctcatcagctttatacatatgtatatgtatatatgtttatatttatatgcacgtatttataagtacattgtagacagatgaaaaataataaaagcaggaagtaccttttgttgtgttgactgtgttttgcccccaaacttacaactctcaatagttgtcttttctgttagctgaaattaaatagagaattatcttagcattttcccccaataactttaaggtttcttaagagatggtaagtccctttgaagactagagtgatttgactcaacttctccttctagtaaaaaaaagtctgccaccaatacatgtttatatttgttaaaataacatacttatcagtatgaagtggcatcagcaaaaccaatgacttaaaggtacaattgtcaacctatgttgaaaatatgttgaatttccaagagggaaacggctgcttgatcagagttcatttatatccacgagcattgcaccagcaataaactttaagttaatgttaacaattttaatttgtatcttttaattgttgaagtctgaattgctttccaatttcccacagagtttaatgtgtatgcaaattgcacagccagaaatttaagatacaaaagatagactgcgttttgcaaacataccataattattgcttaatttttaaagggtctttctctttgtcagggtattgttcggtttcttgaaactgaacagaagaaaacttttggttaatgattagtataaatcttgtaatggaacttaattgaatattaactttgttgttctcacaactacagactactcaattccctgtttctctgaggtagggtttcttgctctgttagtgcaaataatttgtcttctagtaatagcaggaaacagttatcagaacaccagtttaattgtctgaaggttgtgcactacatgtaagctcttagaaaaaggttaaaagaattctcatgtctattttaatattatatttcgtaatcatttaaacagcttggcagtcctagcaaagtaaaaaaaaactaaaattgaaggtaaatgccgttcttttgttaaaattcaaggtaggaaatgctgagatttagaaaaaatatagatataaatatatgtacattatatttagtgtacaatagcatatgtagtatataattatctatttatttatttacttattgagtgtaaaatgaaagcagccaaagcagtacatttggtggattagtagtgatttagctatgaagcatttatatattcaaatatttgttgctaaatattcctaaagcctatggggttctagaaactggcttaggagaggagactgaaggatgaacaacactcattagtgtcttccattgtgttcaagtgtttacacatgaatccaagaaataataagatgctacagatggtgaaaactaatctgaagggggcaaaatgaagccagtgagacacagaatggtttggggatgggggcagttgtgttagacaaggttttagggaaaagatgatgtcagagctcttggcaatgacttggccctaccagaagcaagagacaaagttctaaatgagaacagctggttgtattgaagaaccaaaataggattttaatttggttatatcattgtgatcgatgacttttgttgctttttggtgtctccaaattgcaatcctgtttcacattttgtgttcctttccctcagactattccaagaatgaaggatgtttgatgatggctacaggttgtcttgtacagaaaacttaatatatcaggctctcttgagagagtaggaagggcattttattacagactccagtctaaaattccttctgagtactttaaaatatacccacaaatactggagtcatgtttcttctttttttaattaattaagtattattattattattattttgcgactgagtttcactctatcacccaggctggagtgcagtggcacgatctaggctcactgtaacctccgcctcccaggttcaagcgattctcgtgcctcggcatcctgagtagctggaattacaagcatccactaccatgcctggctaatttttgtattattagtagagacagggtttcaccatgttggccaagttggtcttgaactcctgacttcaggtgatccgcccgcctctgcctcccaaagtacagggattacaggtgtgagccactgagcctggcctttttattttattttattttattttattttattttttatttttatttattttttttatttatttttttttttagagatcaggtctcacttgttgatcaggctggtcctgaactcctgggttcaagcggtccacctgcctcggcctccaaaagtgatgggatgacaggcatgagccgttgtgcctggccaggagctacatttttactccagattcattggtggaccagagtgatttggtgatacttaaactcattctgattttttttaatttttattttttatttgagacggagtcttgctctgtcacccaggctggagcattctcagttgtttaatggtggttttaaaatgttttattatgaaaaatttcaaaaaaacacaaaagtagaatagtatactgatccctcatatgctttacagcagatttcaacaactaccaatatgtggccaaacttgttttgtgctttaatcttcttctcccttccccatcaatattttgaagcaaatccaaaatatactattattattaaatatatcagtatgtatattggaaaaaatgaaactttttaaaaaaagaactgtattgtcattaatgttattatgcctttaaaattagcaataggccaggcatgttggctcatgcctgtaatcccagtattttgggaggctgaggtgagcggatcacttgaggtcaggagtttgagagcagcctgagcaacatggtgaaaccctgtctttactaaaaatacagaagttaaccaggtgtggtggcacacacttgtaatttcagctactccagaggctgaggcaggagaattgcttggacctagcaggcagaggttgcagtgagccaagatcacaccactgcactccagcctgggcaacagggagactctgtttcaaagaaaaaaaaaaaaaaagattatttaagtaggtgtccaaacatcatattatttttaaagttttcagtacttacaattagaatatgagaattcttaaggaaaaaaaaagtactgtcattagcgttattatgccttgaaagtagcaataatctgttaatataagcaagcattctatcattgttcaagtctacctgataatcttacacatttttaaagttttattatcagaaatttaaacatgatcgatatgtctcaaattaaaattagtcgatacatctctcaagtttcttttattaaactggtaccacctccaactcagtgtttgcaatctatttgttgaggtcaccgggtcatttttatgcaacagtctctacatagtctggttttgctaattgcattctttcttctttatattttctgttgactggtggttaaattcagaagtttgatgagatttttgttcaattttgcttttggcaaaaacacataataagttttcttttctttttttctttctttttctttctttttttttttttttttttttgagacagagtctcgctctcctctgtcgcccaggctggagtgcagtggcatgatctcggctcactgcaacctctgcctaccgggttcatgccattctcctgcctcagcctcccaagtagctgggactacaggtgtccgccatcatgcctggctaactttctatatttttagtagagacggtttcactgtgttagccaggatgctctcgatctcctgaccttgtgatccgcccgcctcggcctcccaaagtgctgggattacaggcgtgagccaccgcacctgggaaacacataataaattttcttgtttacttccattaggaaccacataatgcttttctttattgaagtcctttttggaaatttttatcagtcactagcaaccattaccatcactcctttttcatttattagatagaatacttgtacagagaaaaatcttttactgattctttgcttaccccaaggtagagttcatgtgagaaaaataggggcatctgtatcttccttcatttttttccagttttcaaatccgtttgagttagtttgcttgcatattccaaaggagactaatgatcattctaaatgtccattctgaagctctgttgttggccagtgggaatgtctttctgctgtctccttgttcagatggatggagagattccttgctttgtgaggtgacaaggtgttcctggtcaacttatgtatttcctaccctggccctgactctgtgtgtgtgtgtttgtgtgtatgtgtatgtgtatgtgtatgtgtatgtgtatttgtatatgtatatgtatatgtatatgtatatgtatatgtatatgtatatgtatatgtatacgtgtatgtatattttgagatggagtctcgctttgttgccgaggatggagtacagttgcatgatctcaactcgttgcaacctccgcctcccgggttcaagtgatgctcctacatcagcctcccgagtagctgggattacaggcacgtgccatcacaccctgctaatttttgtatttttagtagagacagggtttcaccatgttggccagggtggtctcaaactcctgacctgaagtgatccatcctccttggcctcccacggtgctgggatcacagggatgcgtcaacacactggcctctattatttgtttttagaagcttttcagaaccaggaggcagctcaatttgggagattttgtgaacatctttattattattactttaactctgttcagcacttgtctcaacttttcttattaagtggggagtccccatagtaagcgggggtccccaaaatagaagatcagttctactttttttctcctggagtttcttcttgtgcacacgattgagcacgtgagtgaactcctggtgtttagagtgacagtatccctgggcatagttgattcagggatgggcatgtgatcaggtggaccaccgagagattcctgggggactttgctcttagacgctatggagaaatttttttttctcatggggttgttgatcttgttaggtgagtctagggttattgtggccatccacctctcagtgtactgacatgcaatctaagaaattaggaaagggaaaaatcttgatgctgtcacttgaggccctggatacagcggtgcatgaagttaatctatctactttggaactttgcaagcatgtgagccagtgcattttcttgtatcctctaaagctattttgtgtttgtgtgagcacatgtgtttacacatgaaattgccctgatatgaaggttttctgtttatccagcaagaaagagatttaaaaaagatcttttcaactattttcgctgggcgcgatggctcatgtctgtaattccagcacttgggaagctgaggcaggcggatcatgaggtcaggagttggagaccagcctggccaaaatggtgaaaccccgtctctactaaaaatacaaaaatttgctgggcgtggtggcatgcacatgtcatcccagccactcgggaggctgaggcaggagaatcgcttgaacctgggaggcagaggttgcagggagccgagattgcgccactgcactccagcctggtgatagagtgagggtccaactcaaaaacaaagaaacaaacaaaaaactattttcaaatagcactaagtggcttaaaatacacttcctgaatgtcggctttgtttgaggaatgtgttgtggtagatgctatataataaagggaaattaggctgataggagtttctctcaacatcccgatacactcagcgtgttaagataaggctagaaatcagaataacacaagacagaaacttaggaagttagaaagtgtaagaatgtaggaaaggcgatgaggtcaacattttattacagttattttctccaaactatgagtggatcttggtggtctttttttttcttcttcttttttctctgttgtgtttggtttcccaaagagaggttatacaatcaggccatgatttacaaagaatagtcttgcaggagcattgcgtaaaatgggtttaaagaagaatgaaagatgctagacagatcgtttaaaaaggagtttctgggccaggcacggtggctcacgcctgtaatcccagcactttgggaggccgaggtgggtggatcacaaggtcagcagatcaagaccatcctggccaacatggtgaaacccccgtctctactaaaagtgcaaaaattagctgggcgtgatggtgagcacttgtagtcccagctactcaggaggctgaggcaagagaatcacttagacctgggaggcggaggttgcactgagcagagattgcgccactgtactgcagcctggtgacagagcgagactccatcttaaaaaaaaaaaaagaaaaaattataaaagaaggagtagtttgtgaagccctgttaaatcctgctctcagggatgcatatttacaccctttaaaaataaaataaaaccagaggttgaaacaaggtattaaaatacctctggagaaaaactaacctcttccaggaaagttttgttagctataaactcaaaggttgatacatgtagcatcaaaggaacataggaaagcttagttgatgctgtaattattaaacacaaacaatgtaattaagttagtatgtattagaaaaaaacatgatatgcacatcaagtctaattttattaatagaactttttgggatgagactaaaggacaattccttgtccaggttctacttataaattgcaaagactcactaatggttttcagatgattggttatttggtaaattggctttcagtgggtcaatgaaatggtcattaggagaactgtcaataaatttatctgctttcttttaaaaaaacatcccattttcccagggtagaaatgaggggtttttttttttttttttataaaaaaagtaacgcttcacaaatttgcgtgccatctttgcacaggtgccataccaccttctctgtatcattctagttttagtatatgtgttgccaatgtggacactagaaatcagttttgttttgtacttaatagagcatctttttaaatcttatgcacagaagaatgatgcatagaagaatctgtaatgcataagaagcatcttatgcattatcttttgaatcttatgcatagaagaatatataatgcataagaacaacgcattatatattaattagattaaattaactccattcggatacctaaggttatatttgtgtattaaactcctcaacatcagggtaaaagcaaagacaacatggcatcagattctttgtccaccggttttatttagtctcagagacccaagctggtcagcatttggctctggtggagtcaccatagcctggatttgaaggtttggagcccagcccaggtttggaggatcagtaagttggtatgccagcactccaagagagagaccatctctttgtcatggacacgtcctagctatgtatctaaggtttattagtacaatgaatttctatttaatggctttaatttagaacagttttcttgaaagcctcaacattggtattccattgtctgggcattttttctatatagggaaaatatacaaaagccacatcataaccaggaagatgtatggtgagctggtattcaagaaaggagaagtagctgtgagacaccaaggattggctgtaccagattaagataacctaatccacgtgtctctataagtggctgggtcagctgttggaacctgttgggacagaacaggttgaatccttgagcaaagaggccaggtgaggtgactcacacctgtaattccaggactttgtaaggtgggccgatcacttgaggtcaggagttcgagaccagcttggccaacatggtgaaaccccatttctaccaaaaatacaaaaattagcagagcatgatggtgcgtgcctgttatcccagctacttgggaggctgaggcaggagcattccttgaatccaggaggcagaagttgcagtcagctgagatcgcgtcattgcactccagcctgggtgacaagagcgagattccatctcaaaaacaaaaaacgaaaaaaaacccaaaactaaacaaaataaacacatatcctcacctttttgtgtgtgggacatacagtatgaaaagatgagtgctaatagctttccccttacctttcaagagaacctaaagatacttgcctccattccagtcatcttcctccctttcaatgagactgtgttcttgcttgctttgggggagaaagactaagttgacttatagaatagagggatggcaaggaaacatcccaatacagtcagtatttcttgtggaaggacaaaaagagaaaagtttctgggttatgtctagaaagataattgacaggaatggggagaaggaacccagtaatggcaggtgaacgagaaaattggtacaatgataagtgttctgtaatttttatcttgagaaatggaaaagcagctcctgaaagatcctattagtgatggcttggtgttggtaggaggtggcttgacactcacagatagactttggtgttgcctgttgaacacaaacaatttcatagaatatcagcatcagacaaggccatctcaggactgtggtgggtcaggacaagacaagaccgctaggtgatcatgtctgaactcagtccaaaacatggaccttgcctaaatcgcaagatgaccattcatcttctttttctggctcacatgagtgactgctgcttcttcaccgactacagctttcgcttcactaaattcttcccttcttctggataagaactatgaagatacccagtgatataattggtctttctgacagcatccaatccagagaaaagccccaattctttaacccctactcaggatcacgtaacagaaaggcaaatcctctaagaagctggacagcatcttactgagatactccgtggttcctcatggtatatgttctcctttgcaataggtagtaaaccctactttgttcaaatacaggtgtacatttaaacatctttggctagaggacatacataatgtcattaaatttatttatttatttatttttttttgagatggagtctcactctgtttgttgccaggctggagtgcagtggcacgatctcggttcactgcatcctctgcctccgaggtccaagcgattctcctgtctcagcctctcgagtagctgggattacaggtacacaccagtatacccagctaatttttgtatttttagtagggacggggttttatcatgttggccaggatggtctcgattttctgaccttgtgatccacccgctttggcctcccaaagtgctgggattacaggcttgagccactgcgcccggccaaacaagtttttttatgtagagacagggtgtctattggtcaggctggaatggagtgatatgatcacagctcactgtagcctcgaactcctgggctcaagcagtcctcccacctcaccttcctgagtaggtaggactagagttgggaaccaccacacctggcttggtttcgggttttatagagacaaggtctccctgtgatgctcattctgatcttgaactcctggactcaagtgatcgtccttccttggtctcccaatgtgctgggattacggacatgagccaccatgcctggcaattaatttgattaagaaaaagtaaaccctatgcagaagagaacacttagcaaagttaagtcacctgcccaagaaccctcagctcccaagcagtggaatcacactttgaaccctgccattttctgtctgagcctttgttctgcctttaacatcacctccccatatggacgcaccgtcttgtctcttccatgttttcgtagtcttagttttctaccactgccagaagtaccacacatttggcaccttgaaataacaaatacatatgatctcacggttctataggtgagaaatctagttggctcatctggtttctacactgtgagtttttctcaacgctgatgtcaatggttggctgtatggactgataaggaggctctgggaagagtccattttcaaactccttcaggttgccagcaaaatttatttccttgcagctgtaaagctgaagtctccatttctttactggctggtagcagaagggcttctcttagatcctgggagctttttacgtccttttgtgaagtgtggactcttccaactcatagtcagcaatggtacgaatgcatctcatccttgaaatctcattgacttcttctgccatatgtacctcattgcagctggagaaagtcttgtgttttaaagtgcttttgtgattagatgggattttccccaataatccagagtcatctccgtatttttaggtgcatacttttgataacatctagaaaatcctatttgtcatgtcacgcatcgtattgacaggttctggggattaggacatgggtatcttggggaagtggggcataaatttgcctactgtacattgttaaacaccctcccatcctccagccatctttgactgttttagtcattctttcaatgtaaatgtacgtttctactctttcttgtttggaagctcttctctttaacatgattttgcatgtacttttgctgctaatttcttgactatacagggtaaactcccatgaaaatcatctcatttccctacatgcaggtccttagaaactgtgaggatggggtaaggctgctgccattgaagcctgcacgctcctgtgcgtttctgtagcccacctagtggacacctcagcattaggaagtatcaacatggacttgtaagaaccttcatgctgtctcctcaagcttgctagctggggcctcctagtacaacaggtgccgtgagaaacacgtgaaatggcaacagatttcagaaatggtagcaaaataaaaccagtataatgttgggcattgtgtctctcacccaacttagcattatctatattcagttgagagcaaacttggatccagttttcagccacagctactcctcttgccctttattgtttcatgtacaagttctcactgaaaaaaatatatatccacagcataatcagaatagttgttaccgaagaaaatgtaacaggatgatatttttggcgaattggctttaatgagttttgaatgaatagcttaaagtattagaaagtaaaattcaggccaggtgcggtggcttatacctgtaatcccagcactttgggagactgaggcaggtggatcacctgaggccaggagtttgagaccattctggccagtatgatgaaaccctgtctctactaaaaatacaaaaattagccaggcatggtggcgcatctgtaattccagacactcagaagtcagaggcagcagaatcgcttgaacctaggaagcaaaggttgcagtgatctgagatcataccactgcactccagcctgggtgacagggcaagactttgtctcaaaaaaaaagtagaattcagtgaacaagagtaaataattcaagaaattcaaggttgatagctataaaaatgaaattccctccctccctcccttcctccctcccttccttcctcctcccttcctccctccctcccttcctcctcccttcctccctccctcccttcctccctccctcccttcctccctccctcccttcctccctccctcccttcctcctccctcccttcctccctccctcccttcctcctcccttcctccctccctcccttcctccctccctcccttcctccctccctccctccctccctccctccctcccttcctccctccctcccttcctccctcccttcctccctccctccctccctcacttcctccctcccttcctccctccctcccttcctccctccctcccttcctccctccctccctccctcccttcctccctcccttcctccctccctcccttcctccctccctcccttcctccctcccttcctccctcccttcctccctccctcccttcctccctccctccctccctcccttcctccctccctccctccctcccttcctccctcccttcctccctccatccctccctccctcacttcctccctcccttccttcctctcttgctctttctctttctctcttcctttccctctttctctctgtccctctttcttttttcttcttgtctacttcctctccttcctctccttcctcttcttctctcttttctctctcactctctgtctcttccttctttctctttctttgtacatgtataatttgaagaccctgcgccaagcagtctcttggaattagaagcaccttaaaatgaaaaaaatgtctcgccactgtgacaaatccacaggccttgcaagaaaccctgcagatcactaacacacggccataggaatatattgactgcagcccaagcacaggagaagattaatcaatccaacagacttgcattaattgtgaaatggaagggatgatgcgatcaatgataggaatgaaagtgcagcagtaacgatgccacatccagctaatccaataatggagaagctgatgtatagcatattggaattctaccgtctgggcacttgtcaccataaagaatatcctagaattatagggaaaaattgagcaggcagcagttgagccaacctaatcagcctgataccacagtagttctcttgattaaacactaaattaagtggcattcagctctgtaacctgcttgccttgtgaaaaataatactagagctaacgtgaaaagtttgtattttaatcaaagcaaactacgaatattaaaatattcctgggctattttggtgccgtttagctgtgaacaagtttaataatttataaatggttcttttgccattggctacaaggaaaaagggtccaaagctatattgggaggtaaggcttcctgtgctaaaaatcaattagacttgatagaagctcagagaactcttaagaaaaaaaaaatgcactcaagaggccctgggagaattcaaatttagttaacttctataacggtttgcctaagggcatgaactctattctttgctgcaaagcacgtgatcattccaggaggggtgagacttaatcagctgtgaatactatgagggtcccttatacatatatgtcattattaagtcctgaagctcaaatacacagacaacctagagctaaatggcaaattctccaggaccaagagaaaactgcttttcatgaacatttagagaacactagagaaagaacttacattgtgagcatcaaacccagtctggttagactttctgtacagactcttacgctaggacacacactggtgagatcttggtgattattatatgcattggccagtgagacctcttagagttgaccgagtccgtgagcatccgaggggctagatctctggtggccagtgaaggagatgtgggttggaaaaggagggagagacactgatcacatctccccttttttttttgtttgtttgtttctttttttgagacagagtttttctctgtcacccaggctagagtgtggtggagtgatcttggatgacttaaaccaatggctctctggtaccgcctcctgggttcaagagattctcctgcctcagcctaccaagtagctgggattacacttgcatgccaccactgcccggctgatttttgtatttttagtagagacatggtttctccatgttggccaggctggtctcaaactcctggcctcaagtgatctacccatctctgcctctgcctccgcctcccaaagtgctgggattataggcatgagccactgctcccggcccacatctcttttcttgagcagaagatagtgtgctgataaagttctcccaccaaagtgagtcttagcagggccttgggcaagaggataaattaactacttaggctgttctttcctgttatattttgtttgttgtttgtttgtttttatttcaagtcaatttgtggccttgccttttaattgaaagcaaattcatttttttttttttcctgggtgggaaagggtcactgaaagaagagaggccatcaggctgtgtcttacatagttgaaaagtcaaaaactgcagacagatttggatttatttgatttcaataattagcagtcattcgtggagtcctcataccattccagggctggttctaagggcttttgcaacattaacttatgtaattcttttaatgattctgaggtcaagatgctatcatcattttcactttgcagaaggagaaactgaagcccagaaagcttaagcaatttgccaaggtcttaaagagtgcaagtgtggcagatggggattgaaaccaggcgggctgtttgttgctatgtgtttttaaaacaggttgggccttccaagttggatttttgtttgtttgtttttgttgtgtgtgtttgtttgtttttgttgtgcgtttgttttgttttgttttgtttgttttttgagacgaagtcttgctttgtcgcacaggctggagtgcagtggcatgatctcggctcactgcaagctccgcatcccgggttcacgccattatccagcctcagccttcaaagtacctgggactacaggtgcctgccaccatgctcggctaattttttgtatttttagtagagatgggagtttcaccatgttagtcaggatggtctcgatctcctgacctcgtgatccgcctgccttggccttccaaagtgctgggattacaggcgtgagccgccgcaccgtgccccaagttgtttttggacagtgatatcagtcatgagaaatgggaaggagtgggatgcctttggatgatgttagctcaagtggtattgcatgctcttccaccccatcttctgcacatttctctctggaaatacgcccttcattaatcctctgacattggctaagtagatcatgatgtggtgttctgatcaatgaggtctagtccagtcactgtaggtcaaatcagattatccagacctccaaaataataagtggactttaggtcagacgtatggagtcaccaatgagaaacagcttcagaatccatccagcaaagatctagaataatcataggatgagactatgatcactatcatttattgaccatcactgaatgctgggagctcttgcgggtgtttttgttcaacttgcttaactcataacatcagcaagatgaaagaaattttcccagttttaaagatacaggatctgaggctgacagaccaaatgtctggcaggtgagatctcataactactagtgacagacctgggactgaatcaggtctcttcaattccatcaccttttgtctatgaaagtactcatccttcaggtttctgaggccacatgggtgtgtcataggcaaggagccttcaatcatagatgacatggaaagtcgcatctgtctcatttcccaagccatgttaataactgcctggaacagacagtgagaaaaacaaggacattggaacaccttatttctggtttcctttctctcttgtacagtgtgatttttaaatgctgctaacaaaacattggaacagaattgtgctccagaaaaaaatgagatccaacagacctttctttattatgggacaattaattttaagctgactttatcagcaaagggaggccagagtgacttgctttgtaattgttgggaagctgtgcacactggattagaggagaagtaatgtttcctttcaagttttgacccattttaacaaactgatatcttagtgtgttcaggctgccataacaaaatgccgtagactgggtggcttgaacaagagctatttattttcccatagctggggaggctggaagttcaagatcagggtgccaagatggtcaggtcctggtggaggctctctttgtggttggcagatggccaccttctcaatgtgtcttcagtggcgtttcctcagtgtgtacaggtggagagagagagaaagcaagccctctctttctctccttttaagggcagtaatccccttatgaggatcttacttttatgatgttatcttctcaaaagtcccatctccaaatgtctttagactgagggttagggatttcacatacaaatttgtggtgtaatgctctgatactcattggctttgtgactgagattgagccatttagttctctaagcatcctttctttggtgaaaaaatgcttgtagtccctactcacataggactgctgaggtaattcaatgaagtaaggtatgctaggagcttaactcagtgttctgctcatgttatacgtgcaataaacataaaccagtccctctcacttgaaggaaaaattgcccactttctgacccagagaacatgtgacaatgtctggagacatgtttggttgctacgactgggaagaggatgctactcgcatctagcagatggagtgaaggcatgcctctaaatatcctgcattacacaggacagtccccaaagcaaagaattgtctgtatcaaaatgttagcagtgctgatgttgagaaactctggtataacctatcattgcaacacaactactaatgttatattacctggaatcagggaggagggaggatgccattaacaaattatataaagtctgttttttaagagagactgtttttctctgttgcccaggctggagtgcactggcacaatcactgctcactgcagcctcaaactcccaggctcaagcaatcctcttatcttagcctcccaaggaggtggaactacaggtgtgcaccaacatgcccagttaattttttaaaaacttgtagaaatggggtctcaccatgttacccaggtcattcttgagctcttgatctccaaaaatcttcctgcctcagcctcccaaagggctgggattacagatttgagccacggcgcttggctaaaatgctatatactctattccgtacgtcagtattctcactaaaagaaggaagagtaggtttcaaggaacttgaggatgaaatatgtaacagtattcactcagtatattaaaaataaatacacaatgtcattggaatggccgatttattgggacaggcaattgtgtatgcagaataaatgctcaaaaagaactgtccaaggtgctgaaactttgacaaatgaaaataacctgttcaaaatgatgtgtaaactgaaggttttgtttgtttttgaagtggagtctcgctctgtcgcccaggctggagtgtgcagtggcatgattttggctcactacaatgttagcctcctgggttcaagcaatcctcccacgtcagcctccctagtagccaggattacagtcatgcatcaccacgcctggcttttttttatttttatttttttgtttttattttattttatttttttttaaagtaggggtggggttttaccatgttggccaggctgatctcgaactcctgacctcaggtgatccactctcctcccacagtgctaggattacagtgataagcctcccaaagtgctagaattacaggagtgagacactgcaccccgtcttaaactgaattttaaaggggataactgtctttgcaaaaatacatttaaaaggttgggaaaatatattttggatttgattctcagtctttcaaggtaatgggaatggaatcttgagtgagagagagtggatgataaactagaagccaagttctttaccaggttgttttttcgagatggagtctcgctctgtcacccaggctggagtgcagtggcactgtctcggctcactgcaacctccgtctccaggattcaagcacttctcctgcattagcctcctgagtagctgagattacaggcatgtgccaccacacccggctaatttttttgtatttttactagaggcacttttgaacatattggccaggctggtctcaaactgctgacgttgtgatatacccgcctggacctcccaaagggctggaattacaggtgtgagccaccgtgcttagcttctttaccaggttctatgcttcctgaatgcagggattctgtttatctttttcttgcattatggaatagcataaacttggggtctgagacagagttaagggtcagttcatgttctctttttcctttcttcttagtcactctcagtagtctggatttgttgtggtgacagcagcagatgcatccagtggcattgtgaaggcattagtatcattataggcgctgaggctatgggtgagcatatggcctgggactgcaaatcagaaactgctcgcattcctgggattgttcttctagactatggagtagatctggagcttggcttcttagccttttctgggcatcagaaccacctcagagttggcaaaaacaaagaaacttgagccgtattatagacttatggaatctgaatcttctggagtataaggcactgagcaggaagttttgctcatcagtgttcagacagaggctggggagaggaaaaagtgtttttcccttcccaaatcaagcatcaattaattctcaggactgctttggatagaaggttgttcacattattctgagattttggcttatttaagagcctattagacaccatttgtggttcatctcctcttgtttaaaaggctcttttgagcaaacaagaagtatttgaaatttttttatgactagcggtctagttattcacatttctattatgttccattccattcccaataattcattttaataacattttctttttttttcttaaagattttttttttctgactaataacattttctgatttgggtagaaagaaatattattccacaataagcaattgtgaaatactaaatttacttggctttaattacatctatagaggtaagcaacgtgtttcagggaaatctaacttctctttgaagggtaaagacccagttaattcatcatttacccattatttggtgtgataggcaacaccagtagttattgctgtgtggtgatagggtttctttcttggaaagactacacttcctagtcactcattgcagttaagtgagaccataaggcttgttcttgccaatgaattgtaggcttagtaaagttcatcacttctgggacaaagcatggaagagtgagacaccaccagacatgaccatcccttgccgcggtgaatttgaagtcctttgttgagatcaggaaatcgccatcaacatgtatccccaagtaattatgtggaacgggacctgcctcatccccaagatctgtctcggacatgtggtagatccttctgccatactattcaaactgaagactgggagttaatatggtgtcatggtataaactagcctatagagttgagttttagaagaagcctttcggatactgaaaacaaggcactgaacttaaattctgcagactggatttaaatctgggctcatgtttctcacttgtttcgggacgtaacctaagtcactgaactgccgtgataacagacacagccacagtgtattcagcacacctatgtgccaagcattgcacacagcgttttgcatatatcatctcacgtaattcctccagccacacttccacttgggtagacacgcctcacttggtggatgtggaaacaggcgtgatacacgatgcaaaaccagaaagtggaaatgctgaacttgaagtcacatgtgactgatgcctattcccgtatttttcttttttctaaagtggagttgattaaactgtctacttcactgggccgttttaggatgctgtgagcagggtaggtgacaggacgtggttacccgccaggtgaggttattgtgatttggtttcggccagcacttgctgcagagaacttaagactgtttcttttctggctgtcacttgaccctgtgtaccaaccttgaaatccctcactggcattttggtaaatttgtttcatgtttttgtcccatcagtagtaaaggtttcaccattattttcatttcctggttgagcgaccctctttctttcatgacttttggcttcatccttcagcctctttctctttttttattgttccatgttgctgtgagcagaactcatttttcaaaagacagatggtggcaaccctgttctctctaaataaaaaagcaaaacagctgttaaggtgcaaacagagtcgcggccagcaaatcgtatctgcttcaagtgttggcgaagtttcccttcagggaatgggagctatctaaacaaaatgtgcagcctcggctgtgctctgccaaggcccaagtatagaatgatggcaaataatggaaatttatagtgtactatagatccagcacctttctatcttggcgggtgcatatttaaatgcagtgctaacggagctgaaatttatggctctctaataacgataaaatgccatcagagaatgagataaatcttggccccaaaccttagcatgcaacgcacacactgacgcgcgcacacatgcttgtaaaatatagccagatactgctaactcaggagtctgcgtttggaagaagccaacggaacagagaaagtagaggaagtgttttatagacgactgcaaattgttgttttcatgaggctggggtcaaggtacattgtggcctcaggttgaaatgagtgttgctttgtctcatggctgatacatgcttgaccttggtgagggaagcttttccttttctagatgttcaatagcttttctcttcacgttttcacaaccctgtgacaggccaacttccaaacaaacactgatgaattatcaccctctgggaaaagaacatcgtggtgtgcttaagcgttttcttctgtttgtttatttatttatttgtgcattcattcattcagagagaattggagtcttcgaggcttagcaacaacagagagatgaaagacatttaccaaaatgctatatttgcaaactgtcggcgacgtgtgaattaggtgtgccccctttctctacgggcagttgtggtcttcagggaatggaattttacaaaatatcatttaggaggttgtcattcacgtttgaaaacaggcgtggccagctcctccagccaacctgcatgtacacccagctgttttctctctgtggagcatctaggtcttaggaagggaagcccatctggaaatctgtcttaagcccttgctgaatttccacgagccgtgcattcgtggatcctgcaagttagtaactacctgaagaagggggcattctctactggcttgcattctaggtgtttcctccagcttctccttatgcaaggggacttctaatattttgggcgagatgtttagtttcagtgagaagcctaacctccgggagttgtttcaggccacctccattaagagttagatacttctttctagatgcttctttatgcataattgtgtgtgcgtgggtgttcatgaatattgtcttaattgctcctgtttttgaaatacaacgtctaatccagtctatcattgatggacatttggattggttccatgtctttgctattgtgattagtgccgcagtaaacatacatgtgcatgtgtccttatagcagcataatttataatcctttgggtatttacccagtaatgggatgactgggtcaaatgttatttctagttctagatccttgaggaattgccacactgtgttccacaacattaggagatatacctaatgtaaatgacatgttaatgggtgcagcacaccaacatggcacctgtatacacatgtaacaaacctgcacgttgtgcacatgtaccctataccttaaagtattaaaaaaaaaaaagaagaaatacaacgtctacagattaaaacccactctaggccaggtgcagtggctgacgactgtaatctcagcacattgggaggccaaagtgggaggatctcttgagctcaggagttcaagaccagcctgggcaacacagtgagacctcgtctctacaaaaaaattaaaaagcaataaataaataaataagcaaagaagaagcaaaaagaaagcgttcttgttcagaactgaaaaaaactgttcctggtttcctagtttttagaagtgtgtgtgtgtgagtgtgtgtatgtctgtgtgtgtatgtgtaaagactgagaggtaatgatactgattgagttgaaaataaccattcctttgtaatatttctaaaattttttaggacactaaattattttatataaaattatataatattaggtggtttggtgtgtttgccttgtttaggttttgttaggttggtgcttgagaaaaaaacaggtagatttggaaaatgctgatgtttaggatgaaaagggatccaatttttcatataaaatgaattctttggagtaagaccttttagctgagattcatggacttcatgaaagtatgtgtgtgtttgtgtgagtgggagagagagagtgggagagtgcattcatgctgttgtaggttttgctaagagattttgtactttttgttaagttgtcaaaagctctcttgtctgaacccctgagcccatggtcctctctctcctcttgtttgtgctgtggatttgcagttactttacagttcgaatgaatgatctgttctgtgaatacgtagtttcattttacagttagaatgatgtgatcagggctgtgattcctaggctaggccattactgggaaaggtgtgacttggaccagaaaaaaagtaaggaagtgaatctcatgctaaagagaacaagcttggtttcaaacactgcatgtttatgggctttgcccaccaggtttagcttgtacaaggaaatacccacgccccaattcccattaatcctgaacatatgattctctctagctgttccacacctcccaatctgtggtccagcaatactgacatttttgcgtgtgttccaactaaaccctgctctcttttacctcccagcctttccacattttgttctctccacctgaaactatattccctttcttctggctctctcttttttttttttttctctgatgaagtgctgctaccctcaggaaggcgtctgtagtgttttctagatcagcttaggtgaacctttcatgtcttcctgtagcctccccacttccattgtcaaggtatttactacaattgtcatgtctcaggccaggtgcggcgtacccggggactcttttatgccatctttatacctctgtgtaaatctaaaatattttcttttttttctttgtttctttgtttctttctttatttcctctttttttagacagaatcttgccctgttacccaggctggagtgcagaggcacagtcttggctcactgcaacctctgtccgccaggttcaagtgattctcctgcctcagcctacggagtagctgggattacaggctgccatgcccagctacttttttgtagttttagtagagatgaggtttcaccatgctggtgaggctggtcttgaactcctgatcttgtcatccacctgcctcaacctcccaaagtgctgggatttcaggcgtcagccaccgcgcccagccaatctaaaatattttcaaaatataatgtttatgaaaattaaataaaataaggaatctaggtcaatatctgtgttttatcaaagcaaccagaagatcagacatgtccacataaagagtgatgaacttgtattaacagaaaaggaaatgacattggacactgtctgtgtcatcacactgcagagggaagaggaagaggaggagggaaatgtccttccctctgagaaccatgagctcagtgaaatccctgcattcccacccacatccttaatgttcccagtatccaccaccctgaccggcttaagtgagcacttaagaatttttctcgaggccagtcttgaaggctcatgcctgtaatcccagaactttgcgatgctaagacaggcaaatcgcttgaggccaggagttctagaccagcatggccaacatggtgaaatcctgtctctacttaaaaatacaaaaattagttgggcatagtggcaggcatctgtaatcccagctactggggaggctgaggcaggagaatcggttgaacctgggaggcagaggctgcagtgagcccaggtcgtgctactgcactccagcatgagtgagagagcaagactctttttcaaaaaaattgttttttgttgaataaatgaataaacgaagcatcacaggacaagggaaacttgtctcttctcagttagttgctgagtaaattgttgtttcttatgtgttgcgtcggcccccacctcatttggttactacttgagtcctcttggtttcattttattttctctctctctctatatatatatatttactttttaatatttaaaaacatttttgaatattttagtatttatgttcttatatattttaaaatatttttatttttaaatttgttttatgtatgttttttatatatttgtatatatgttttatatatcagtattaatttttaatataatttatattgtatatattttatattaatattttatataaatattatattttataaaatttataaaattttataaaatttttatatttataaaatatattatattttataaaatatataaaagtaaaatattttattttttataaaatataatattttataaattatataaaaattttattaaaatttttatttccctcagcctatttgcacagactggattaagtgtccatcatagtatttaccaagctttttgcacataacaaaaatgaccctaaaaacaagagtaacagtttttatttattgagcatgtactatataccaggcatgcttgaaaagcctttatagatttatttctaattcttgaaggtagttggtattatcttcattctaaattgccagaaccttctttctctctctttctttctttcttttctttctttctttcttttctttctttctttattttcttttctttctttcttttctttctctctctctctccctccccttccccctccccttccccctccccctctccctccccttcccttccccctccccttcccctccccttccccctccccttccccctcccctttcctttcctttcctttccacagggtctcactgtgtcacccagattggagtgtggtggagcaatctccactcactgcaacctctgcctcctgggttataaatgatcctcccacctcagcctcctgagtagctgggactacagacacacccctaatttttgtattctttggtagagacgggatttcaccatgttggccaggttcgtcttgaactcaagacattaagtgatccacccacctcagcctcccaaagtgctgggattgcaggcatgaaccaccactgcacctggccgtgaaccccatattcttaaagatggtagagctgggattcgaagtcaggtctgcttaaacccagagcatatcttcatgccccacatttccctctgtctctctgagtttatggagttggttagaaatgtcgtatttctttttctttctttatactccagattccctgtgaggtcaggaactaggcctttttcatgataaccctagtgaagatcctaattttgaaaacttatctaatatttattgggaagctgttgtgagccaagcactgcagtaggctctggatatattaggcccatccccgtatagagctgacatgtagcagatgaaagcagaaaaagagaaaaaaaggtaagtaggcaaaatgaggaaaaacgaagtcttagtatgggccaaacagtttcctaatgtttggtatattagctcattttatccatgagacaagttctattcttattgacctgattttatatccaaggaagctgaggggcagagaatttgaacaactgcctccaatgttcacacagctagaatgctgcagaactagggcttgcaccccattgtctcactcttgagtcttcattctttatcactaaatagacacagccaggaaggaggcagaatgggcagtgaaatgcttttgcagaagttggcatttaatgtgaaggttgaaaaataagaaggaatgaccatttgaagtgtagagataagagaatcctatgcaaaaagcccagccagtgcaaaggcactgaggtaggagagagctgagtaaattcaaagaaaataaaacacatagtgggaggctgcagaaggagggaggtaatgaccattatgaaatgaatgggctgggcatggtagctcatgactataatcctatcactttgggaggccaaggcgggtggattgcctgaggtcaggagtccaagaccagaccgcatctctactaaaaatacaaaaagttagctgggagtggtggtgcatgcctgtaatcccagctacttgggaggctgagacaggagaattgcttgaacccaggaggcagaggttgcagtgagccgagatcatgtcattgaattctagcctggatgacagagtgagactccatctcaaaaaaaaaaagagagaaatgaatgatgggcttgagttgggtggagcacttgatgccagggctttaagaacagcctggccaacatggtgaaacttcgtctgtactaaaaaaaaaaaaaaaaaaaaaaaaaaaaaattagcttgccatagtggtacatgactataatttcagcactgggaaggccccagtataccttggaactcctctgcctaggttatctcccttgtcttaaatcagagatgggtgttacttactctacagtacacagaaacaggtatcacttatcaatccctgtgttcttttccacttagctcaaatacagcctcggcatccttctgaacactctggagtaggctgccatttttaatcacccagatgttaaatttattcatcatccctatatatatttcccacaggatcaaagtatatcgagtttggaaagggagttgaaaacaaggaagactccctgcttttgattcccatgagggcaatagctgtcactctcctaggggatgttttgataagacagccacttaggtttctatatcctcctgataaccgtatgttgaaaaaggatttaagaggaaggtcataaaaccagggatttcttaacagcagggtgtggcttggcttactaagaatatacttgtgatgcattttaatgacatgctttatgttatcatattaaagattgtaaaagcatctagtaatcatttaataaatattaatgaagcatttacaaattgcaccttaatttacagcattggcactcatatcgtgctctggacatgaatgcacagagacatggtggctttgacaaagactaccatggagagcctggttctgtgacattgtgccatcctggtaccataagtgattttttaaaataataattcttggagggcagttgagtgcaatgaagcttgatgcctaaagcagttttagcaattatttttctgtttggggaacattaaaacataatctaccatgaatttataatccatagcttctctctcatgcacttcttaataataagcagtagttataggcccttgtgcaaaaattctttgtagatgttaggagatacttcctcattgtgtaaacactggggcaggtaagggatatattgcaagcgataactgtggggtcgccactcccctgccaccatctttgtttgatgcttagggagatctcctgttctttgcaggcacttagatacgaatggaggagccccaggcacaaattcctcagcactctgtcctgctcttgttgctggacttgattgtctttcagacagtgcattcaatgttgagttcagagccattccctgcaattccctctggaccctgttggatgttaaccacgatggttctcacacggggctgggtgtcacgtggctcacagaaaactacagatggaagggccttagaagtcacctgctgcactcctcactttatagaggaggacactgaggcccagagaggaacaggacattcacaggccacacaccaggcaagaagcagagatgaaactgttacaggcaaggggctggatcccgaccccaagagagcgttctcagatctcccgcaagacaagagttgagggcgtgtctgtagagtgaagcgaaagtatgtttattaagaatgtagaggaataaaagaatgtccactccatagacagaacagccctgaaggctgctgcctgcccatttttatggttatttcttgatgatatgctaaacaaggggtgaattactcatgtctcccctttttagaccatatagggtaactctgtgatgttgccatggtgtttggaaactatcatggcgctcgtgagtatagcagtgaggacgaccagaggtccctctcagggccatctgggttttgatgggttttggctggcttctttactgcaaactgtttttatcagcaaggtccttatgacctgtattttgtgctgacctcctattttatcgtatgacttagaatgcctaaccttctgggaatgcatcctagtaggtctcagccttgttgtacccagcccctatggaagatggagttgctctggttcaaacacctctgacaaaaccggatcccaagacataagattgtgcagtgtgcatttgcatgcttctcagcctcagagctaaggagacctgggcatgtcctgggggggttttggatagaggggggcacctcttcatcaggggtgctggagaaggcctggcctggcctctggagcctgccgcactgccagtcaggacatcctagctgagcaggagccatgggcgtcccggggaatcctaggtactgagaggagatggccagcagatggcgctgcagggattcaaactggagcagccatatctgacagcaaccccaggtcagggattcaaagctccagcaaccaggatgagctgcttaatagtacaggcctggacttcagggatgcctagacccctctcgggagctcccacctggcctggaaagagagccaggtctagaatgggctggtgcaggtatctgtagactggtcatactgggtttgggatcagaccccagaccaagaaggaacaaagggaaaacaaaaggactagcgcagctgctgtgtccaggctggggtgcttgctatgtgggcaggactatggtcacaggccagggtggaaatggcagccagaaggcctccctctgcgtggggtctcccttaaacccaacttcttggggcctactctgaggacatcaagaccgtctcttctaggaaggcaagaggccaacacccatgaagctgctgtttttcctttcctgctcctgacttggaggcgtggagattgccaccaggccatgtttaatgtcttttaattaacggtttaactcgggtatccatgatgcaagggttttgcaaaggaattcaatctagttttcaaaattgcagaattaagtgggtaaagaacagttgagggcagcacttacatttctgaatatttagactctttttttcttcttctttcatttttttcacacttccaatctgcctcttttcttcttctctctgtttctatctctctcacacacatacacaatcacagctgcttcatacggcttctccccgtcccctctcctggcagctgtggcgtttctgcacagaggtgcagggaaggaggaaaggccttgggtcccctggtcaggatccagctgaaacaaccagaaatactgtccctgtacctctcaggtcgggtgacttactgtgcctctgaaccctctttcttccatacctcccctacccaattccgaggcctcaactttgtgctgccagagggcactatgccacctttaaatgagatttagaaaaagtttacacatggcacctgctgatctggacattccagtcggcttgctgtatctcctagttgcaagggagggctttgcttagagcagcctgtgccccgtagggtaataccggagctggcggcctcccaggaaggctgcaaagtgcttgggtgctttgccctctctgaagcatacatcagcacccctaaggtttagctgtgctgcagccacagcccacacactcctccattctccctgaacaataggacccttgctgagatagtctggtaggagaggggaggctctttcctgaacccgtctctcctaaacgctttctatgccttagagtgctaagaacagtctaccctccttacgagactgagtgtttcctgaaggcaggagctgtatcttattgaactctccagcgcacagaaaaaactcataaatatttgttcaactaataaacaagtaaatgaatagagaggatgaataatcttttagggtaagttaattacatctattttatttaaaatgcattatagaattttgtctctgtgccaggaactgcttaaagtattttttagatataatctcatagatgcctaacaaaaaccctgtaagttagacacccttaacatctccttttttcaggtggaataggagaggtacagattgggtaggtaacttgcccaaggtcaggcagagccaggattcaaactcaagcagtctggcttcagggcttttttttctaaatcactccctgtggtttctcttagtcttagaccaagactaatgtacttagaaatacccagccagggaacaagaatgcatagaatttaatcccccaagcccaactttcattattcagctttcaaaagacatggcagggaaggtttccagacagaagaggaatagtcagtttgtttttaattcaccagtaaaacaaatagacttctttccttttatatttgtaacatacagcttgcatttttttttattttaaacaagaaaaggaagaaataaatgagaaagaagggaaggaaggtggaggaggtgggagagagaaaggagagggaggagagggaaaccgggagaaaaaaagaagggagaagagaagggaggaagaaaagaagggaaaagagaaggaaggagggagagaaggggaaggaaaaggaaggaagaaacaagggtggaaggacgaaaggcaagaaggaagggaagaaggagaaggaaagaaaggaagccttatttaatctccagcacagaaagtgttcgcagccctgagaaacgtggtttctcatttgcctgttacttggcacagtttgactgcctagaagcctgcagaaatattggaagtcaaggtccaatataataattggcttacagatttgaagaaggatagatagactcttccatttccaagattcattagtccagctttctccgtaatagacagggcttgctctacgtgtaagccattttctaatcaaattggcacacagttcatgctctgacttggtataaatgggcttctgtgaaattgctctgcctgggctcagggctggagttagatgggatggattttatctctctgatgcttgatcatcttgggctctgcatggaggaaacctgtctctactaaaaatataaaattagctgggcgtggtggctcatgcctgtaatcccagctccttgggaggctgaggcaggagaatcgcttgaacccgggaggcggaggttgcagtgagctgaggttgaagcattgcactccaacctgggcaataagagtgaaactccctcacacacacacacacacacacacacaaaaaaaaaaaaaaaaaaaaaaaaaattgaaccacacatcattgtgacttctatttgtgaaatgttcccaaaggatatttgaaaatgtgaaccaactgtgaattattgcaggacttgatatgcacaggaaatgtaatagggacgtggaggttcgtaatgtgagtttggaaaccatggaacatccaaacattggcgatcaacaaagccagcagtatgtggacagcttatgagaaaaggtgtgggcatcgcttggatctgagtgggaatccaagctctgccactcagctatgtgttgctaggaaagtttgcaagcatctatgaaataatgaaagtttaaatgaccatagcagcaagcatgctgtttggaagaccaatctccagatgaacttaactaacggtttctagtaatgctaagcataaaacagaaaaaaaaaagctatatatatatatatatatatatatatatatatatacacacacacacacacacacacacacacacacacacacacatatacgtatatatatatgtgtatatatgtatatatatacacatatatatacgtatacgtgtatatatacacatatgtatacgtatacgtatatatatacacacatatatatacgtatacgtatatatatacacacatatatatacgtatacgtatatatatacacatatatatatacgtatatgtatatatatataaaatcaagaagagccagaagagattggaaagctctttggccctgatagaagaaagctgatgcgtcacacagaagaaacatgagtcttcagttcttcttttgctcttgtcttctctgtcaagaaaaatcatcttcagtcaggatggaatagagtttggtttaggtgacaaagtcagtgttggtgaagcagaatgaagagagtgctagctcttaagaaatctaatattttacctggactaatatctccaaacaggagagtaacttggacatgagatcattaagtatcattgacaatttgtggcaaaaagcagaagggtatgagatttgaaatgcggaaataggatattctaattttcaaaacagatgaaagaagctgggagactctataattatagggtggtagcatctcatggtgtaaccactattaatggttcacttgttcaatgattaaagtcccatgtgatctgatcttcacatgaatctggacattatgaaaagcatggcttgtggatttcttgaagatgaaagaatgataacttgattcttatgtccattcattgggaataatgaagacccagcaaatgccatttcttctcactagaatgggagatttggagaatggggtagacacatgatgtgtgaattccagcaagacagtcaacaaggacacacttttcggtcacgtgtgtgtgatccctttatgggaaaagtggaggatggtgggatagatagtcagaaaagtatgtgggaaagtaaaacattattacaaattggtgccaaaaattataatgagtagattggcccataaccctggtggttttaattgtagtgatgtcattgagctttgttctgagatatgtcctgatggcattttttctaaatggttggatcatgatagagaaggctgttcttcagtgacacagatgggatggagtggagtgcctctgtttaatggagtcaggactttcatacccattttacagatgaggaaatgaggcatatgaaatgtattcatttcctagcattgccataagttaacgccaactggatggctttaaaacaacagaagtttattcattcaaggttctggaggccacaagtctgaaatcaaaatgtcagcaaggccaagttccttctgaaggctctagggtagaatccttccttccttctcccaccttccagtggctccaggcgttccttggtttgtggccacatcactctagtctctgcctctgtcttcacatgctattgtctttgtttctctgtgtgttctttgctatttcgtatgtggacactccctttggatctaggacctactctaatctactatgattttctcttgatccttaccttatttacatctgtaaagactgtatttccaaataaggccacattctgaggttctgggtggacctgaatttgaagagacactattcaacccattatacaaagttatggggtctaattaaggccctcaaataagaggcaggtccaggacttgacttcatccgtgtctgactctaaaccacacattttttcttttgtcttaggggagataaggatagggaaatgaatccaatccttgtcatttgacaaagagtggaagggaatgtgggtatttatcttggaaataaaatgatcaagaaaggacatggggtgtgtggagcagaatgatcctgcagaaagaggacctttatgacctagttggtttgggatgggagatggtgtatgatgctgatgctgcttcttccaaggagggtagccagggttgtaagtaagactgtagactgggtggagaggaagcaactgcaggtatgctgcaggatagtggctacagctttgcatgtagagagtcagcaatgccttacagttaagaaaataaagctaagcttggctgcctggcctggaatcctgactcctctatttactcatgatgtcaactttggcaggttgtttaacctttgtgactacactgtagagataaaagcagtatcatggctgggtgctatggctcatacctgtaatctcagcactttgggaggccgaggcaggtggatcacttgaggtcaggatttcaagaccagcctggctaacatggtgaaaccccgtctctactaaaaatacaaaaattagctaggcatggtggcacatgcctgtagttctggctacttgggaggctgaggcaggagaatcacttgaacccgtaaggtggaggctgcagtgagccaagccaagatcatgccactgcactccagccgaggcaacagagtgagaccctgcctaaaaaaaaaagaaagaaaagaaaagaaaggcaatgtcaacgacatcgggcagatgtgatgaataattttgatgggattggcgagataatccagtactttataaatgctacctattgtgatttttaaaatactatactctgtgccctcaaacaacatcccgtgttttacccactgcagagaagatgcagatggcttgtgtctcatggggcctggctcacatgtaagccaacgtggtccttgctggcctgctggacacacagggagctccactaccttgccttctaactgatctctccctgatcagtataattacggaggccctgctttcttccagcagccaaattgttgggatggacttcctcgttatttgaagcatttgttactgaagttagtatggcctcctggctttgctcacatctgggaaagaaagtcgattctcctttgtatttagtggcttggaagctgccagcaactttcggatggccgtagtgtcccctcttgagaatcagagaatttcattattatttttaaaaatcttatcttggcggggtgcggtggcccacacctgtaatcccagttctttgggaggccaaggcgggcggatcgcttgaggtcaggagttcgagaccagactgaccaacatggtgaaaccccatctctactaaaaaaacaaaaacaaaaacaaaacaaaaaaatttagctgggtgtggtgggaggagcctgtagtcctagctacttgggaggctgaggcacaagaattgcttgaacccaggaggtggaggttgcagtgagctgagatcccagtgcactccaatctgggcaatagagcaagacttcatctcaaaaaacaaacaaataaataaataaataataaaaatcccatcttaattttttaaaggaaaaaaataaaacctatggtcatgagcaaattacagatcagctaaatcttatgtgggaacatctccccatctacagctatttctgtttgtttgtttgtttgtttgtttgttttgctagacgagtattttccctcctcaagctaattgcttgatggaattaaagacgataatctctaataattccagtgaacacatggttcattttcaggtagttttatcctcgaatttcacttgttattttgttgtcggtggcaaattttccttttaccctctatgagacacccccgccttgggtctacctgaactaaaaatgcgtttggtgtctccaggctcatggcatagccactctgggaaacttgtctaacttccagattctcaaatttctgcagctgagagcatgtctctcttttgggaaggaggcttttcctggctggtgggagaacagcttcaatttgggagacagtgtgagtcagcaggaataacgctaaatggctggaaatcagctcagcaaaaatagcaggagcacctactgtgtagagactgtccactagccctgtcttcagaaggcaagaaaggaatgccaactctctcctcttgggctgagtggggagatgagacagggcagggaagaaggaaagtgcagtaagcaggttctgatgacgaggcggtaaaggtgttgattttagggattatagggagaccacccgtgccttacctcctccttaaaagtccaaaaacaggacgggcacagtgggtcacgcctgtaatcctagaactttgggaggccgaggcgggcagatcacccgaggccaggagtttgagaccagcctggctgacatggtgaaaccccgtctctactaaaaatacaaaaattagccagatgtgatggcacatgcctgtaatcccagctacttgggaggctgaggcaggagattcgcttgatcccgggaggcggaggttgcagtgagccaagattgcgccactgcagtccagcctaggggatagagggagactcagtctcaaaaactgaaaacaatggtgaatgtgaacgtcctttaagaggacagagctgatcatcatgggtgatatgcttaggataactttaaagacacagaatggctccctgtggggcaacttaacagaaacaaaagcagatgaggaagggaggctgggatggggcttggttccctattgaacagtagaaagacattttgtccgggcgtggcgacttatgcctgtaatcccagcactttgggagcgtgagctggggaccagcctgagtaacatagcaaaacctcatctctactaaaaataaaacaaattagcccactagagtggcatctgcctgtgggcccagctactcaggaggctggggcaggaggattatttgagcctgggaagttcaagctgcagtgagctatgattgcactgctgcatttcaggctgggtgaccaagcaagaccctgtctaaaatgtctaaaataaaataataaaggcatttaattcaatacttagtgaatacttggatttctctccattgcggagatgaggtaggtatggcaggggatggggacgcggtggtgcaggtgtccatgccatggcttaagtgccatccctggagcaacaggacgttgtctgagtgattctcattgctggttctggattcaaatagcctgggtttgactcctggctctggtttttcctaacttggggcaccttgtttagcctctctccatctcagtgctctcatctgttcaaggggataatgataatgacagtatctactgggtaaggtccctgtaagaagtcactgtaggatgaaggcagaaagctagatcatgcctggtaatgaccaggttggtgctggaggagagggggctgaggttggagatcatcaatgcaccaggggtctcgggatgatgaagagagtcgctgccctctgcttcttcccccttcttccttgctgggctccagctggctgaaagtgtatgaccatctatctctagggcacttcagaaagatggatgggaagtgggaagaggggatgaggctgcctagagagccttgaaattttaacttctgtgaaatatccagagaagatccctggcaatgtttttgtgtctatctcattgaagacacatcagtgaggctagcagagggccctctttattggggagcagaacaggagacattcgcctttcagtgaggacacctcacatcagtgcccctgtagatttattgtgaattacctggggtttgggggaggggtctcagaaaatgcaatttctaattcacttggtctggggtggagtctaagatattgcattactttttttttttttcttttttcttttttttttttttttttgagatggagtcctgctctgttgcccaggctggagtgcagtggcgtgatctctgttcactgcaacctctgcctccccggttctatcgattctcattcctcagcctctgagtagctgggcctacaggtgcccaccaccatgcctggctaatttttgtatttttattagagacagggttttacattgttggccagggtggtctcaaacttgtggcctcaggtgatccacccgtcttggcctcccaaagtgctgggattacaggtgtgagccgctgcaccgggcctctgagacagtgcatttgtaatgagtttccaggtgatgccaacgctgttggtcctcagtctcactttgagtgttaagatcctgcaggatactccaagtgagaactgtacttgggattccgcaccctccccttcattcctcacccaggcttgcccatttgactgtggtgctggcccatttatcctagttaaagggttccacagttccctgtgattatccctcatgatacggatcacgttatacacttaaattaaataaaatgcaccctatcgaatgcactgcacacaaaaagaatatttatttgaatattaagtacagataagacttcccctgggattatttcagagcgcatttgcagaatttaattgcaatattttcccactcagtttctttctgaacgctacttgtgaaaatattttctttctgaaggtaaagctctgcgttgttggtttattattattattattttaaatctgaagagctctctgagctcggtcattacttccagtgtctaattaatcctgatgatgataaagtaaacagccaggtgacctagattttccttttaaattgctagcaattaacatgaatgcctgctcattgttgcagaacttttgggaatctagtccttccagttaggattccttaagttgggggttttaagagttcattttgtgtgaagcatatgtcttccagcactccttccattaagctttccaggaagaatgtgaacacagacacacacacacacacatatacagagcaacagtcaccaccaccacccagccaaccctttcagacaactgaactggaaaattagaaaatgaatactcctcaagtttctcaagctacagaatccttcccatttcttaaataatgacattttgtaaagtcatagaaatcagcaatagaaaagacctcttgtgtaaagatctcttcagatgcgaaagtcagaatagcatggaaagacagcctggggatgtccaccttgggtgccttctatccctatttccttgtctggagaattggtcccatgggacttagttcaccttgacatttttttttttttccatgacagccttgtagttgttacatgatttatttcttttgacattctctacaatgtgtagatgtggatttacagtgtcccatcctaaaactttcagaagcagtagccaatttttcacaatcttggttttctaccgctgtgttataggaaaggggtcccaatgcagatccccagatagggttcttggatctccctcaagaaagaattcagggcggccgggcgtggtggctcacgcttgtaatctcaatactttgggaggctgaggcaggcggattacaagggcaggagtttgagaccagcctgggtgtctgtactaaaattagaaaaattagctggatactgtggcggctgcccataatcccaactattcgggaggctgaggctggagaatcgcttgaaaccgtaaggcggaggttgcagtgaaccgaaatcgtgccactgcactccagcctcgtcgaaagagcaaaactccgtctcaaaaacaaacaaacaaacaaaaaaaacaaaaaacaaacaaagaaaaaaaaaaagaaagaattcagggaagtccatagagtaaagtgaaagcaagtttattaagaaagtaggggaataagaatggctagttcatagacagagtggatgaagggcagaggagcccctcatcagagtggatgatgagccccttggggctgcttgtttcccatttttatggttatttcttgatgacatgctaaacaaggagtagattattcatgcttcccctttttagatcatacagggtaacttcctgacgttgccatggcatttataaactgtcatggtgccagtgggagtgtggcagtgaggacaaccagaggtcaccttcgtcaccatcttggttttggtgggttttggctggcttctttactgcaaactgttctatcagcaaggtccttacgacctgtatcttgtcttgtgctgacctcctatcttatcctgtgacttagaatgccttagccatctgggaatgcagcccagtaggtcttagcctcttttttttttttttttttttttttttttgagatggagttttgctcttgttgcccaggctggagtgtgcaccggcacaatcttggctcaccataacctccacttcccaggttcaagagcttctcctgcctcagcctcccaagtagctgggattataggcatacaccaccatgccagaggtcttagcttcattttacccagcccctattcaagatggagttgctctggttcataaacctctgacaattgtgatgctgtctgctaaatatctaaggaaacagtgaggcacgtccagtccactgtcaacttatgaaaagaagaaatcacaacaacaacaacaaatggactactgaattcagtttactttcttgtagtgaaaaggcacgttatatagtgctttccgtgtgataggcactcttctaattgctttgcaaatattaactcattcaaatcatgtgatgaccctgtggggcacatgggtagacccaggcaaggaatttgttcaaggtctgtaagctaataaggagttgagttgagctttgaaccttggaagtctggctttcgattttgttctctgaaccactgcattttagatgcctctcaaatgtctctcagttaatatgatcaagatgactgcccagataaggccatggcctgtgtgtctctgctgaatctatttaattgggatgcagattataaaattatcaacttctgataaaattattattagagctctgtaatatccaatgagaaagaaaaaaaattacagttaaaacatcttaacttgaaaatgtcttgagaacatatattctatcccagtagagagattcaaatggtatgtaaatcccccacttgccctcccctccacactctttcccacctctggatgtagagagggggatgatgggaaaatcttcgctgagatgctcattctacacagagtttcctggctatagggtaacgatggtcccaggagaccggttcagggaagcatgccaagcccttttagttacccaggacattttggtgagtattgcttgaattttcttagactgagcaagggtttgggatgggatggggttgaaggagggcaattataacccttgatcatgagggaaagaaatggtgattgctttcgctgctgaaacaaatagaaatcatctttgtaataactgcaattgttttctccagccctcctctgccttggttcacaaaataccttattaaatctggagaataaaaatgtacctggggtaatggtttattattagaataaataataggcaatatgtttcttccaccctgcaaggtatcagatgccaagacatttcgtggtttagcttgtaaaggtgcttacatgtgtcagaccagccaggctcttcatggccaggggctgccctttcatttcaagaccagcatcaagcctgaagtgaacaactccacgagactgcattcttgcagaaagcagatgtgggaggccgaaggggatattggccacgtgctgcctggggctgccatgtcttgctcaatgtttgtctgtctgattaatctgtctggacctgggggacttcttttgttgataatggggtctttaccaagagggtgcatggcagagcaagtgtgaaaagcacttcctcccaagaaaacacctcattaaaacgtgtaatttgaggtttgttcaaattctgtgggcatcctgacctctgacatccctttaatcagataaccaacacttgaatctctccagtgacttatagccagagcagtgactctcttgatataagtaccattattaccaaacaatatgatgtttaaaggaatatcagaagtgctcactaaatgtgttgtcctgcctgggagatagcaccccataggtcattcgagtgctaagaatactaagtgttttgagattttaggatatgctccataaagtattcccgaggactcttagccataaattaaatatgttagagctttcagcatttgggtttattgtgcaagtttacgtataacaacaaatccattattattttttctacttagtacttagccttgacaagctctttcgtccgtctcccttgaccctccaaagctggcatcctttcaaaaccagacaagatttttacagcagataatggtcttccccaaggttaagaggaaaacatcgtgggagagctgggtgtgttctccaagctattttctcaagtgtattttgttcgtttatgcaacatgagacagaatcaagttcattaatcatggctgacttgagtcattgttgtgactttttgtttttacttttttaattgattatttctcacctcctttcctgaaacctaagcatttactagtgtaacacacttttgttcttccttgtgacaaaaagtaacaaccgccatgaccggtggtgggatctgtatttgcttatctgacataaactatcctgtcttcttagaatcagaggacacactttattgtgtgatacacttgcaagaagcagtgggtatgattacaaccatacgtcggattataggactgtattatgttcaaagatttcaggcctttataaactcaggtatctaataaacattacacatgagaccctagaagcagacgaggcaaagcgacctctctctttttattttctgtttgtacttttactttcctactgaagagaatccacacaaaaatacttatgtccctgcagaattggagcttttgttttgtttttcaagatagccaccctacatttactcttttggtgctatggggagttattttattattattattattatcattattattattattttgagacaaagtcttgctctgtcaccaggttggagtgcagtgacatgatctcagctcactgcaacctctgcctcccaggttcaagcaattctcctgcctcagcctcccgagtagctgggactacaggtgcccgccaccatgctagctagttttctgtatttttagtagagacggggtttcaccatgttggccaggatggtctcgatctcttgacctcatggtcctcctgcctcagcctcccaaagtgctgggattgcaggtgtgagccaccgtgcccggctgagttattttatagccaccattaatcacatacttactatgtgccaggccagatttggctttgatgctctacaaataacatctcatttaattattacaataaccatataactcaggcatttaaattatattattattgctgctcttagtatgaatttataaaactgatgcatgctcattgcaataagttgaagtgatataacagaatccaagattaaaaatgagaaaacctgcttctctgtcccttcttctccactattggtctggttcccaggacatcatttttctgcttttgtctgaagtttgttgtttatcattccagacttttttccaggtataaatggatatttttctgtgtgtgtaccttgtgtgtgtgcatagttttttatacacaaatggattataggttaaaaatgattttaacttgcttttgttttattttgtcatagacatcattcctgaaatcattcattttctaatggattcataatattccgtagtataggtcaaagtttggcaaattgtggccatgggccaaagacagctcactgcgtgattctgtaaataaagttttttttttgttttgtttttttgtttttttgtttttttgctggggggggaaggagtcttgctctgtcccccaggctggagtgcaatgatgcaatctctgctcattgcaacgtccacctcctgggttcaagcgattctcctgcctcagccccctgagtagctgggattacaggcaagtgccaacacgcccagctaatttttttttttttttttttttttttgtatttttagtaaatacggggtttcaccatgttggtcaggctggtgtcgaacatctgacctcatgatccacccgccttgtcctcccaaagtgctgggattacaggtgtgagccaccacatccaaccctgtaaataaaattttattggaacacagtggcacccatttgtttacacgttgtcagtggctgcttttccaccataatgggagaaccgagtagctgcaacaaagacaagagagtctgtggctctcaaagggcaatgcatttcctatttggctcttaggagaaaaagtttttcaattcctaatgtagatgaaccacaattcttttaaccatttcattacttgtggacattggcattcttctcagttctgggtctgttctgtgacaagcgctgtccttacttcctcattcgccgttgcactctggtaaagtgattcctagaatactaaccattgaattaaaggaaatggaagttctacatagtgataactgccagctgccccctcgaaacagtcagtaccaatttaccacccttcttaaaaagataatatcaaacctttcgaaaggaatctgatgctacaaaagtgtcattaatttagccaaattcacaaggcctcttggggaacaaagccaggatttggacccaagtcatttgacccagtgcttcttgtgaaaacctcctgtgtcattaatttgaataccaattgctggtatttgctgaatttttaaatgtgttaagtgctttgcttagtaattcttatagattatgctcacaataaaattagacactttgcaggtaccatattatctctatggtacaaatggggaaattgcctgcagagattatataatatggctaacgttacttaggagatgttcaaggactggacttccttagtctgattccttaacctccagtctccattggggagaaaactggatctacagaagggcccagtgctttgatatcagagaaatctaatttggtggaaattatactggttcttacctcaataagccaagtttggaaatttatgtgttttatggaactagacaacactagctagtcggtgcatgtcttgttttagagaaacacaagtgtgtaaacagcatcttgtcagggcacagtagctaatgagcacctgctaaggacaagtgaggcgcagattggggaggagggctaacagtgtaggtatccatggttttgtttggtttacctgaccctggaaactgtgtacaatggtgattcagagaggaaacctagtcaacccatccagatggtaattccctcttgaatatttcctatctttacggttttaggaattcactcactctgtgcctcagtttttccacctgtaaaatggagctaaaatcaaatcagctaatgaaatcaattgtcagctgcttacaaagttctgagaattaactaagcttataactaggaactgtttagcacattttatgacatattacaaacattggatacattttaacgaatgttagtgtgcaatttatttcagcaaaaagtgattaaggccaggtgcagtggcttgcgcctgtaatgccagcagtttgggaggcccaggcgggcggatcatttgaggtcaggagttcaagaccagcctggccaacatggcaaaactccatctctgctacaaatgcaaaaattagccgggtgtggtggcgctcacctggaatcccaggtactcgggaggctgaggcaggagaatcacttgaacctgggaggtggaggtttcagtgagctgagattgcgccactgcactccagcctgggtgacagaggaagactttgtttcaaaaataaataaataaataaagtgattaaaacaattactttcctagcagcatagttaaaattgagcaaaacctaaatattttgcaatcccaaagttccttcgcttccatcctccaccccccacaatctccctgactttatcctgcttttgactgtgccattcacggtatcttgtttctgtatccttggggaggtcctcccgcccaactcctatttactcagtaagggttagatcaagggtctcagctccagaaacaactgactgatgtctcctccactgcttcccgtccttcagcaggctgggttggtgcatctcctttgagcacccctggaaccctgttttttcttttctatcacatacgaccctgtatcatcatcattattttattcatcactcctcccctgtcttttttaaataaaatgtacaatgtgtcatttagatacacaccccctttcattagcacagcgctaggcagttagtaccctgagtacatatgtcaaatgtgtatcatagtcctgaaatgcatcaaggaaaacgcaaactccagggctcaccctaggtacttggagacgtgcgtttataggaaaatgccatcttgtttcagaagagtttataatgattacaaaaacagcaacgctgagaaataaagctaccaattgatttgatatattgagttctatgctggtaaacttgtccagtgttttccttctaagtgattcataattgtcctgaaaactggattttccaacattctattattgtggacatgaaaacatgaacatctatttatccattcatttattgtgtgtcttctgtttctttggactcctactttccccagttcaagttaatctctcaccagttccctcttgcacttgactcttgtgtcatattcaattactgcacttccataatctcactgagctttccacacatcctcctgcctttcctctgaatatatttttttcattctttacctggatacattgtctaaaagacaaaacaaaaacaaacaaaatacactaatacctttttcaattctccaagacaagttgggccacctcctatgcactgcaagcacctcttacactttcactgtacaaatgttctctgtattgtaattatccatagactcatctttttccccacctagacaatagctccagtagccttctttgctgttgtattcctggcacttaggacagtgtctgacatccagaaggtgcttgagatatgtgtatgtatatgtgcatgtgtgggtatgggtgtgtatgtgtgtgagtaaatatatatgaaaggatggatgagtaaacaagtggattccaaacatcgtactcatctctagaaaaggaaagccacctaaggctcagttctagttcttgcagagccagtctgatgtgtgggagagaaaaatcagactgaaaacagggtcagaataaagcaggaagaactgataagagagaactcaaagtcaggagaaggatgaaaaaggctgagtgagaaagcgtctttggccctgttggctaaatgaagataggagacggggaagatgaatccctgctattaaacatctcgttcaaccgggagagcaaagggtctcatgctgaagtttattgcttcagtttctaacctttcataagtgcttacttggcagccctttcaagagtggtatttgattctggaagcatcttaaaggaacagcgcccgaccttccactttactttttttcatttaggccataaaatatattggttttgtgcattactgccatgggagaaaaaaaatatcacatgttagtttccaaatgaaatgacatttgataaagtgtacatttaagatatttttcaaggctagcttttaaagaatgcacaggcagggtctttcttcatcacagactgtagggagttacaggtgcctttttttccacctcccctctccccacccggagcctctcccataatggttatggagaaaattttttaagagcctcattagttgcagcaataacttactgagtcttccaagaatcattacaccctgtttggggtgctgtttgatgagcaaggttgcagccgaaacacacaactcatgatgggattctgccgttttgtgcaatggacagctctttcttcacggaagatgtgaggaaagcatggatctgcattcgatgatccctacttaaaggaggggaggtcactggccacctaactcatgagatgtgtatgtcactggattgactcaaattggccagggactcccacttccaaacaaaggggttggcagtaggtggagtatggtggtggtggtggcaaccagtttactaataatttatgaaatggaacaggtgcatgacccaaaaaaagaagcaggatattgtcactagaatataagcaaaataatatgggatgctgtgcagggaaaaataaacacaacaaaaacaaacatgtctactatagagattacttgaaatatcctttttcttattcccaaatctcattttccttatttggcttcatttgaaggacagcatggctatttccttggctactgttggattttgcattgtctgcaataggaatatgataatgtggtgccacttcacatggcacaagtcagaggtcagtaggccccctggttccttcagtgtcgtcattgtgcttttgtgagtctggcaaatccttgtgatatttgaaggcagatgttaaaaatattaatcttgttatatactttttttttttcaatagagcgagacattgtctcgctttgttgcccaggctggagtgcagtggcttgatcttcattcactgcctacctctgccacccaggttcaagcagttctcttgcctcagcctcctgagtagctgggactacaggcgcattccaccacgtgtggctaatttttttgtatttttagtagagacagagttttaccatgttggccaggttcttctggaactcctgacctcagatgatctgcccacctcggcctcccaaagtgctgggattacaggtgtgagccaccatgcccggccaagataaactttttattaattaacgaaaatcaatgctatcactattactatacatttttaaaaacacttgtatttctgcaaggtactgatattaaaatacttgctgattataaatgccctgtatgtcacaaaggatagtttgaaaactacagaaagcattaagaaggaagcattgccctcagtctttaattgcatcagccatttagtttatattttacatgtagacaggtgttccattttgacttaatttttgtataaagtgtgaggtttaggtaaaggggtgtgtgtgtgtgtgtgtgtgtgtgtgtgtacacatccagttactctatcattatttgttctggatgtttcacttttttcggttttcttaaaggttgtgttatagggattatcacacacatatttctctcagtctacaagactcagtattttgcctctttagttggaatgcagaaaccttatcacccatgttaattagcttgacttcggtgattgtttttacaatttatacatacattaaaatatcaagttcaatacgttaaatatatgtaatttttattttttaattgtgcctcaataaagatgggagataataaagtttatcaccacgtatgcctctttgtttctgtagtctttgtgttttatctttttttttttttttttttttttggagttggggagtacagagtctcagtctgtgtgcaatggcatgatctcggctcactgcaacctccgtctcctgggttcaaacgattctcctgcctcagcctcccaaatagctgggattacaagcacgcgccatcatgcccagctaatttttgtatttttaatagagacggggttttgctgtgttgaccagactggtcttgaactcctaacctcaggtgatctgcgagcctcggtctttcaaagttctggaattacaggcgtgagcccctgcgcctggcctatattttgtttaacttccgtattgtatatccataaattaaaaagctcttcatgcacttccctcccccccagttttttgctttaagccattaaacatattttaatgaactcaagagtatagaaagctcttcatgcaatttcctttttttttttttttgctttaagccattaaacatattttaatgaactcaagagtccagtcacctattaacatttactcatatgtttaccatttccatttccagctcttcctttcttgttgtttgaagtttccttcaggtatcctatttcctttatctggaaaacttcctatagcgattattttagggcaggtctgtctgcagtgaattttcttagttactttcatatttcaccttcatttctaaaggatattttcattggatgtagtattctcagttgacaattattttttcagtatttcaataactgtgtgttattttctgctgacctctctggatttttgtttgtttagtttggattttgttttaaatccatagttctttgaattgttgggcccttacaagcattgcattgtttgtctctggttgttttcagtgttttaattttaggctttaccaatatgactgtgatatatgtggttgtggatttcgttgattttaactcttttagttccttgaaattgtttatatcttttgtcaaatgtaggaagttttcagccattatttcttaatttttttttttgcagtgaactctttatccttatattctagaatttcagtaacatgaaatattgtacgttttgatatttgttccacaggtcctgcatttctttttttttttttttttttttttttttttgtcttcaatttttttttcccctatgttgtttagaatggatactttttatgtactcaagtttacttctttttcttctgttgtcttcattctgtgtttggacaccttcagtgagattttattttattccgttttaattaattaattattttttttgagacgtctcactcttgtcacccaggctggagtgcagtggtgcagtctttactcactgcaacctccccctgccgggttcaagcgattctcctgtctcagccgtctgagtagctgggaataaaggtgcctgccacaacgcctggctaatttttgtatttttagtagagaaggggtttcaccatgttggccaggctggtctcaaattcctgacctcaggtgatccgacccgcttggcttcccaaaattctgggattacaggtgtgagccaccgtgcccagcccaatattttatttttatttttttaaaaaaatttagttatttttatggttgtaaaatttccttttgatttttttgttttgttttgtttgtttgtttgttttcgatggagtcttgctctgtctcccaggctagagtgcagtggcacaatcttggctcactgcaacctctgcctcccaggttcaagcaattttcctgcctcagcctccctagtagctgggactacagtcgcgtgtcgccacacccagctaattttttgtatttttagtagagacagggtttcatcgtattagccaggatggtctcgatctcctgacctcatgatccacccgcctcagccttccaaagtgctgggattacaggcgtgagccaccgcgcccagctccttttggttctttattatcttttgtttctttgctaatgctgtcaatttttttctcagttattttcagtgtgttttttcttaccgtttggagtcgttttataacagctgctttaaagtttttatttgataattccaacatctttgctatgttgatgttggtgtctgtgaatgtcttttcccatgcaaatttagattttcttggttcctagtatgctaagtcattttggtttgtattctgggtatattgaatattgtgttaggagactctaggtcttgtttaaaatcccatggaagttgttgatatttttgttttaataagcaatcaatcttgttgcattcaggctgaaagctcttgcttttcttctgtggatttgtttccaatatcagttctgttgggtgtctcccatatatatatcaagtctgggacatgggcagtagtctattccttagttcaattctcaaagcttatggaaacattttagggtcagatacagacatgagcacagaggtcagtgcaggagtttataaaaatactgtttgggggtgattttcccaaattattttctctccgggatcctcaaagtaatatttgttttctagggttccctgtttgttgtcctccacccagaaagctggtggttttttgtttgtttttaatttttctgttcacctgcttctcatctgagtctgcatttagggcaaagtgtcaagagaagagaggaaataaagaaaagcaatgggaggtgggagttgtttgcccaacctcttgagaccacagtcctagatgttaagtgtctgcagccacccctgttgccactgttgtttatacatgaacactaccctgagattgcctggagactgcagcataagaggacacacaaacttttaaaaagaaagaacagtaataaaaaaaaaagaacaatggggattttccctattctcttagtgttaagactcatctgtcttgtttttcaagacaaaaccagagtgcttctcctgagtctttatatggctgggtgtctgattttcagcccttggctaccttgcacccacactaaggggtattggtggtgggaggtggtaattcaccacttatgtggcggtactttaaattttggtcgttttgttcccccctccacttgctgctttttaattttcagagatctcaaatagctcccccatgcattctatacagatttccttgctgcattcagtgggggaaacaggatgaagtgttttcgctccatcttgtcaagaaccgaaacctcaccacccacttcatttattttgtgttaaaatacacataaaataaaatttaccttttttatcattttaaagtatacattttactggcatttaagtacattcacaatgttgtgcaaatatccagtttgagaacattttattcaccccaaatagaaacctcatacccattaagcagtcactcctccttttccattaacccagtcctctggcaacatttaatttgttctctgtctcaatgaattttccctacttcatcttttaacagtttatggagacataatttacataatataaagtcacctatttcaggtgtataattcaatgtgggctttttttttttggatatttatagaattgtaccagtttcttttttaattttttggaatatttctcccagtcttttcctctttagcttctttttttttcctttatttttatctttttttttttttcttttgagatggagtttcactcttgttgcccaggatggagtataatggtgggaactcagctcactgcaacctctgcctcccaggttcaagtgattctcctgcttcagccaactgagtagctgggattacagatgcccaccaccatgcccagctaatttttgtatttttagtagagaagaggtttcaccatattggccaggtttgtctcgaattcctgacctcacatgatccacccgccttggcctcccaaagtgctgggattacaggcatgagcaaccgtgcctggccttccttcattttctttaatgatctgtttcactgtatttttaacccaagataggaaccataatattgtatatttctgtggtttcttttcttaacaactaaatggtgtcttttgaacatttttcatatctctatatttaaaactatgtttctaaatggtacatgttatgccatactatcagtatactatattttttaatttttccattatcacacataatgtttataatttcttttttcatacataatgttgttgttaattgacatggaaataaacatttgtgtgcctctgcatatttttttaagagctaatcttagtggtaatatttctgggtaaaagggcatagaaaagcactgatttatagatttggggctctggtgcatccttaagtaaatattcttccttttttgtttttagagaaagtcaaaacaaactttgtatacaaaatgcgtaaaatatacatcaaaagttggttcctaaaccttcatatcccttagtaaaagtttcaaaaacttacagtatattgtctggtcctggaagtcgggagttgtttcactggttaaaaaaaaatactggaaagatatagaataaaggtgaatgaagacctaaattttatttcagcttaactattttagttgacagtggagtctaccagctcctgatgacagaatgaccatatatctcaaaattccttctatgtgttcctttttatttgtgtccttagcataatcatgtaatacgactccacccatccccttaacccacctatgttttcttgtttggataataaattatatggccactccaaagaagcgtccttggacattaagtaaaacatgtcagtagggcaaagataattaatgcatggcatatgtattgctaatacccactttcctatctgatggccgataccagaaacctatcaggatctctttctgtgattgaaggattggcttcacaattctccccagcacaatcctatggggacttactaccatctgattagaactggaccataaaatgtaacccagttgccaaggcatgacaactgacactactggccctaaacattggagaagactttgtgtgttttccactgacttatcatgaccatctggagtgggcctttatggaggaattcttgcacctgtgatatagggcaagctggggttttcagggaaaagggtggggagtttcatgacaagaggggaggtgccctcatcccaggcagatgctgcctcccacacatactcctgcacgtctctcctcttcccctttccagtctctgacttatcctagctgtgcttctgaatcacacaattgaactccaagtgaagcttgagctatgtagacctaaagaaaaattaaatacataattaattaattatgggttttctttgagctgagtaattaaaagtaactttctgttttctttcatgtttttctgatccggagccttctgacttttccccttcattttcttttctttctaggtttcaagacaacagatgaattgtgaaagagagcagctaagggtaggtgcacctgcttgtaaaatgcttcctgattctcatttttgtgtgataagcaaaaatttccttgtctctcccaagacacgggttctaaataacaggcttcatcttaagactggtagagttgaaaatatttatcccagcttatttagtattgattgagctgttaaatacagtatatcttctttggaagtgccgttatagtagatatggattttttgatttagattcagcaataaatacttttcttctggaatttgtttgacatcattgtactctttttatgtacaacacgaggtctaagtaataacaaaggtcaaaaggatggctggctgccttcttaatatgaataccaggctgtttgctgagtggctaaaatgctctttggctgttgactggggtgggtgagcaaggaatatgtcaagggcgttttctgggagaatttgtgttatctatagacctcttggttttagtgacatttgtgtatatgggagagggagacaaaattttaaaccttatattctgtttccccacttaaaaatgaaactgtcttggtgctcaggcatatcggtgtaagaagtattccctagatgtgcagggagtgtttggttataaatggagcttggtgacattgttctgctttcattgtgtcagagtggacattcttcttggtatggggatggcattttaagaaactttgggatttcttcccatttgttttcttctaaatgaattcgtgttttcagtggatgagatttagattatgattggtgtatttttcatgtcactaatggaagttggcagtttttactggacaatgtgccttatagccatgttttcaaattgttataaaaatcagagaaatatgctgcttttaaaaccacaacagtgggatttggcgttaggaaactcctgtgcccaaaggtgtctaataaataagcataatgtatttaacaggcctaatgccttcatacactgccctgtaacttttcagagcatttacctaatgatagtctcatgatggcaataatttgtagagttgcttccatttcacagttgctgttggcatcaggtttgtgaagtacttgggtaaaataaacaacagaatccaggtgcatgaaaccgagaaagtgagacaaggttttctgtttcttttatgcatatttgttttatgcagtatctcagtatggccctctctacccactttcctccaagtacctgtgccgacattcgttgtgaccctttccttcatggaacagacttcaagatttttaagcttttctgaactgtcttactgcttttttcctgtagtctgaattactggttcatcctgttaaataatgtattacaactttagatttctcttgctgtttggatggggacgatggtcagaactaggtcagagctagataaagagaaatatgtgcctttgtctccaggagtccctgataaatgcctgagaattaagataatattgaaatctctattgcaaatgacacttgcttggcaagttaaggacgcagtaggtaatgaaggacctgtttgcattttgagggattatttcccatttatgagtccattgtcgacaggagtgtggtttaggttcaagaatggagtcttcccctctctgttacataaatgcagggagtggcttgatattaacataatggttcatttagtttagtcccaagtatggctccaatagccccatctctaacatcacgaaccagtgctttgtttgttgttacttttatggtcactgttcttgctttttaaatgaatttatgttttgaattgatagatggcacatttgattggatagagcacacatatatagggttcaaaatttaaatagtaccaaagagagtgcaatggagttttcccttcccacgtgacttaggcgtctagttccctctgggagacccctagtgtgattaagtactggtagctatctcatctgtagatattttcttctgccctcttcatttttgttctctgtctttccatctctttcttcttcctttcctccctccctcttttcctttcacacctgtgtctgtaagagcccttccatcacctcaaaagaaaacttcccttattaaggtgattttttttttcggggggggggggcggggagcttttttttttttttttttttttttttagagagagtctctttctttcatcatgctggagtgccgtggcgcaatctcagttcaccgcaacctctgactccctggtttaagcaattctcgtgcctcagcctccagagtcgctgggattacaggcacgcgccaccacgcccagctaattttttttgtacttttagcagagatggggtttcaccatgttggccaggatggtctcgatctcctgacctcgtgatccgccagcctcggccccccaaggtgatgggattacaggtgtgagccactgcgccaaacctgggtgggggggcattttttaagggtttctgaaaggaatttagaactggaaggtaaatacctgtccatctcaatgaaatgcattttcctcaatctcattttgctttcttagaaagagagtggaagaaaattagaaatctgtttagttaccacatcgttgaagggtaactgtctgcaagccacaataaaaatgtgtcctaagtgcagcagtcaaaatgcatttccagatttgctatccaggatgactggactgtggccgtgttatcatgtcgagggtccttcattagtgcattctgttgtcagaattcagggatataagtggatagttgtcaaatttattccttttccttggcctcctggaaatagcagatgatttagaaagataaagctgcgctttctgttttgtgccccatcgaggctgtgtaggaattggcgtatccaatacttggtgttaggatctcctttctttttctcacgaagcctaaattaatttttccaaaacagacactgtgaagtgcttaatatcttgaagatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgtttttctaactcagctgactacgcaacacttttgtttatagaacatactcttgagatcatatcagtattatcagttaagatgctattatctgtgagttatagacaagctaagagttatggaaaagctaagagttatttacaaaaataaataactctccacctcccagttccagggttgattcagaggctttttggtatcagggcagtggtttgcaatccctgtgcttccgttggcctttctttccttcttccaagatgtctgccatctaccccatatcacgttctcacagggcagcactctcatcagaaggaaggagaagaggagtttctccttcacacgtcttgcattttactgcaggaaaataattcccagaattcgtcactgcagtcgttttcttagatgtcattggccaatctctacatcaatcactggcaaggtgaactggaatctcagcgattggctacagcagttatgattcatttgcagcatcaggcacattgttacctgcacaaaagtaggatttacttaaactggaggaagcagaaaatgcactccagtgttgttacccaatggagtctgctacaaaaggaattcacaggggtccactctgtttgtcagggtgctggtttcctgtcattagttttcattactctctttcatcctacatgtgtgggctcagcaactttgtgaattctggtttgtggaatttgacacagatgatttctctgccaacattgaatctcacaggtcacatcttccatcctaacctatatcctaacttttctacccatcttggcattgtctttgtattttgccttgtgtaatttggactgcactggatatagtctttggtcatatcccctcagcattaggtgtgggcagcaggcatggggcatcgtgcattagtaaccagctcagcccacagatgctgtccatgagcttcctgtcccctacccttccccaaagaagggcatcagccagttactcccaacagtagggtcactcttctcagagaactattgggattacttacatcgctcggttgttacgcacactacacaacagggaaacttgttcattcctccgtcccaaggtttgtcaatctagagtagactgagtgttcttctgagcttgcaattcacattattggctggattcttctggggacatggtcagaggagctcactatggaatctgtgcattaaccactcctgatcctataggctgtatttaccagcttgttctagcatcagcacaggttatggtgatagtcgtacagtgaccatatccaattatcaacatttacctctccagcatctgcaccaacagatggacaaataaacaactaagagagaaataaaatgatcctgggggcctgttgtttccctgaactatctaccagttgagggagattgtatgttcatagggtgggagattccaaagcccacctttctgagcactcataaaatatttgattacaaagggatctttgtgcttgagtggtagatgttggtttgggggctgattaacgagcttagttagaaaactactaggtagccaaatgcatgactgccagattctgttctgtggattcaaatactgatctgcaatatggcaatgtgactctatagtcagcatactaggaagggtggttagggctggtgaagcactggtatggacttaggttcagatcccacttctaaatgctccttagtgtctcaaagctttactttacctatacgtaaaataagaatagctttctcataggattggtgactggataaaacaacttcgttaaagcactgaaaaaaaaaaaaaatgcaggcctgatactcaacaaggtgagctactgttaatacagtgttattcccaataattatttcacttctcttcctcctagaaataccaggcatgagaatacagagaacacatatctactgccaccaaactccccacaaggaaagacaacataaagggcaggctctgtatttgatttcatggtgaagtatttaggagataactccctctcagttaaggttgtttggaatgcaaacaatagagacagattccagctatcttaagcagaaaaggcatgcaaccaggcctcccaggaatcagagcttagaatgggaaagctgcctgaactcaacgtatgtcttgctcatctcctgtctttgtttctgtttatgggtccactctggatttttcttttgataaagactccctctacctttatgcacacatcacaccttctagcccctaagatgtatgttgcatcgctttccaccggtatagggactaaccatcagtgcatcctcgttacaaattcctggaaaaggagcctgattggcttagtctggatcagttgttcactctgggccagttggatctgtccagggaagtggtatgaagcaacacagttgcccagggccaactcttgagggaagacttcattactggggaaaaggagccattgctagctgagtaaataacaccatagatgccgggtgcagtgactcacacctgtcatcccagcactttgggaggccaaggtgggtggatcacctgagatcaggagttggagactagcctagccaacatggtgaaaccccgtctctgctaaaaatacaaaaattagccaggcatggtggcgggcgcctgtagtcccagctactccggaggctgaggcaggagaattgcttgaccccgggaggtggaggttgcagtgagcagagatcatgccactgcactccagtctggtcgacagagggagactgtggggaaaaaaaaaaaaaaaacacgaaaaccaccagatatagatctctgctatgctttcaaaatgtggatatcagctgaacaaaggatcctggaaaatacatgtgctaccaccaactgctagctctgtatttctcaaaatataggacacctaccgcacgtcttactcacagctttcaggcgaacactaactcattaagaaagggggaatcacttagaaagttactcccctttccattgtctctctgtggtttttatgccaatcagaaatgctcagtttaaactaaagtatctttagcagggctgtaacactttctaagctttcttttttaagggaaagggagtgtgcctcaggatgagagcctccagccccagagcatctctttgcactttgaaaacattgtttgcaaaatacactattaagaatcaggggcctggagctacgcctactgagataaaatctagactttgcaacttagcactttgtagccttgtacatgttacttcaatcctctctatgtcaaattcctcacctgtatagtggagataatcattgcacagatttcataagtttgtgtgtgtgtgtgtgtgcatgcgcatgtgtcttcgtgtttgtatttttgcatgcaaaaaaagattaaactaattaatgcatatgaggttgttagaaaagtgtctggaataaaaaaggttcttaattattgttggatattaatggatttttttcattaacttttatgtgtgactgttgatattggtttttcatttaccgtggcaatacaaagtttccttggcacacatcgtattttatgttccatttattgttccacttatttaagttaaaaatgggttgctttaaagataaatattaacttcataatgttacatattgcccgcagttatgacaaagattgtgatactggaatgcaaatgactgagttttttagaaatactgaaatcatggtacccgccttgtgaaagaggttgtagagcagatctgcattatcaatatttaatttgccagttacaagcgagtttctcatttctgctagatatgagagtgatgtggattgcataatgaaaattgctaatgatcttcttggcttaaacccatcgccttcatctggacatcagataatgaaacttcccaactgccttgcaattgagctatcagaatcagagataccttctcccgctgtgtctcacccctctccactttttaaagcccagcttttcattccttagtggctcttacgatagcacggaagaaaatgtaagccccccttctccccaccccttggtgagacctcacaggatccatgagttcttcctgactataattttaggatggttcgttgtagaaatgcctgcttctgttcagttatttattcaagaaatattttttgagcagaaaccgtatgccaatcactgtgctaggcagtagaggtataataatatactaaaacttgcaccactcttattctcttatacctcacagcctagtggaaaagacatgcatttgtcaaataatcattgacaaccattggcaaaaaatgttcaatgtgaaactgatgaatatgagaaacaagagatgctgtgtaaaagggtatgaatagaagaagcttacctgattgaccttcacttatcaaacgtaccagattaatacatactgtcccatctctttataaagcatattggcagatgtgcacagcatcctatgtagtgactgtttggtacaaatttacctttctcttcacccgttgcagtgtctgcttgccaagagtcagttgtatttgttcccagggctgcttctgccagctgcacttttcattgtaattacattagttagtggaatattatgtaaactgatgaaaaatgagtgcagtaagaaaaagagctgtttctatgaaaactaaatgctttggaaacattgtatgaaaacacgattcaaaaattattttgcttagctgtgggtgagaagactgtaaaatattagtggaaaaaagccctcagaaatgtggaaagattctgcagtcagattcttttcaatgtgtcttgacattctcattccactttaatcaaacccagaattgataccatagagttaacaaactttaaactttttctgaaaaaagccagattgtgactattttaggacctgaaggccatagggtctccattgcccccactcgacactgccataatagcacaaaagcagccatagataaaatgaatgattgaggctatgtctcaataaaactttatttacaagaacaggcagtgggccatagttagccaacccctgctggtgactgaaatgttagtgaggtgtatgtgggaaggttaatgagggatttttatcaacagagaaatcattcaaagaaaaggccttagactcacatcaaagatcaataaatgcatgcacgttcatatgttttacattaaaacaaaagcctgaagttatttctatatcactttaaaagtgatttcttgctttaaaggcttccagttaaataccttctgccattctcaaatgaaatggcttttaaagaacagaatagctacaattagggctggaaacacaaaataaaattatgcttatttttatgttccaaccctaatgactcagaaccccatctgtctataatggaagaacaaatttatccttttttattggatcccccagcaagtaatttctgggactccccaaggagggtgacatttccacgtatacatcctggtgcttgtcctatgcaaattgttgttcggctgttccagaattctcccctcacttaagaaaagtctggtaagttccctctctggattgttctgtcctcaaaagcattcctctgtaagcatgaataccattctttgcattaactttccaaatgatcagctaaagccagacttcagtgattagctcaggggttagcagaaatcccaggtaggtggtgacttacagagaaccctcaggattcaggcctgagatcttcatggttgatgagatttcatgtatgttctcctgtgtgtgtgtgtgtgtacgtgcacgtgcacacatacaaggaaaaaactggcagaagtttgcttgctttaatcttacataacgaatggtcccaactttgtgattttctccaagcaaagggagtttgccccaaagtaattagttctctacttctagaagctgcaggaactcaggcaaatgatccccaggggcagcttctctagtaaaataagaaactcataagtacatttaaaatgttttttaaaatgttttttaaatgtcatcttcacaagacctgttccatacagagcttgtatgttctccagtctttgcaagaacattaattgatgaacgcaaggaaatcaacttcttgattgattctgatcaagaaatcagccaactagtcacagattttaatttctccaacttcattgtgaaatatgattaaataaagaagtgtacaggtgtccacttttcttcatttttgatgctgaatcttataattcacatatatgttaattaattctttgagtctccccaggcatttgaacactttatttggagaagactcaaaaaaaagttcacacatttaggatatttggcctaatattcattctccctttcccttgctttaatttagcctattatccccagtcctcatgcccctttccagggaaaatctattcccatttcttgctttatcattaaatctgtatcaaacagctccaagcaaatcgctaataatgctgacattttaatttgtcatagctactcttcatttctatgactgatgcctcagcaaggacttgtcttcctgctctgttcctttgaggtctaaataccatttcaggagaaaaaaaaatacgtgataggcaagggaaatagggcaggaagcaaataaatagggcatctctagttccctccagttgggggtaggaaggggcaagtttcagtgggaatgagtaaggagcaagaaactctcctttcctgatgatgcagacaaacctgagatggtcccaggaaaaatggcaacgaggccgggtgtggtggctcacacctgtaatcccagcactttgggaggctgaggtgggctgatcagcaggtcaggagatcgagactatcctggctaacacggtgaaaccccatctctactaaaaacacacaaaaaattagctgggcatggtggcgggtgcctgcagttccagctactcaggaggctgaggcaggagaatgccgtgaaccgagatcatgaggttgcagtgagccgagatcatgccactgcactccagtctgagagacagagtgagactccatctcaaaaaaaaaaaaaaaaaaaaagaaaagaaaaaaggaaaaatggtaatgagatataaaagctttctgtcttccttcatggccatagttaaaccttatttaccctgtgcttgtatgtggatgaatcatgggtacagcaagcatgtgcttccttgttgtctgcagtatatgcttccttgttgtctgcatccaacagacatttctgcctatggtagctagtactttattattctatttgggttaaatttcctctttcacgtgtgcagtcttggagagaggataaatcacaacacctgtccctagccaacagatgtggatatggccaaggcaggacagttgaattctttctcctgagactctgaatattgagtagggtaatgctaaatatggtgaagaaaacaagcatgattgaaaacctggagttcattcatttcggtagtgatattctggtgaaattgagtgaagagacggttcccagggctagacctcagattcaccctgattcctgcctttatgtttaaccctggttatccatctatccgtcccttaagctacctcatctcattcaaatgatcgccatttttttttttttttttttttttttttttttttttgctgaagttagtcagacctattccttttttctgtgatcgaagaatccctactgatacactggggaaatgtgctaaacttggagaactgcagagccaagagtttggttaaaggtttgctaaaagccaactcttcatcataccctgcaatgcctccctgatgcctctgtgaatcggcgctgactttatgtattgacagctaagagaaaggagctcttggtttagggcacacgcagggctagatgcttacctgaatttgtacatctttttgggtcagttctcagtcatcaagagcaggtaggcacaggaagagaggtctgtgcttcagggtctttggaactctgtccttccctgtaggagtaagatattccccccaaccccaggggaccacccccgtgcccacagataaaggatctgtatcagtatcaaagatatatcagtatcagaggaacttgtgatgttacgggatcatcacatgtctctctgccaacttcttccttctcagagtacccttcaaaggccactgagaatgtttataacaagtgccatttcctcagctctaccccagacctactggatcagattctggagatggacccaagggactatttttaagccatttctcaagtgggaatgagagttgagaatagtacttttcaaatttagctggtaaaatgttttgatgtctcagccttatcctaggaatgctattggcccttcatatctgtaggtttcatatttgcagattcaaccaactgtgcttcaaatatatttagggggaaaaaaaacccaacacacacctgggtctgcacggaacatgtgcagactttttgtcatcattccctaaacattctggataataactgcttacatagcattcgcattgcatcaggtattcaagtaatatagagatgttttaaagtatgtgggtggatgtgcataggttatatgcaaatatcactccattttatatcagagacctcattttatatcagcatccatggactttggtattcgcaggaagtcttgacaccaaggtccatggatatggaggaacaactatactaaattatcatgttatatgggctgagttgtgtcctgacaaaagtcatacatggaagttctagcctctagtaactcagaatgtgactgtacttgaagctaaggtctttaaaaagataagtaagataaaatgagtccataagcgtgggccctaatccagtatgactggtgttctttttttttttttttttttttttctgaggtggagtctcactatgtggcctaggctggagtgcagtggcgtgatctctgctcactgcaacttccgcctcccaggttcaagtaattgtcttgcctcagcctcctgagtagctgggcctacaggcacccgccaccatacccagctaatttttgtatttttagtagagatggggtttcaccatgttgcccaggctggtcttgaacccctgacctcaggtgagctgcctgcctcagcctcccaaagtgttgggtttacaggtgtgagccaccatgcctggctgggtggtgttcttataagaagaggagattaggacatagacacgcacaaagggcaaactacatgacccaaagggagatgatcacctaccagtcaaaggaggatgatctgagaagaaaccaacccccctgacacctgagtcgcagacttctggcctccagcactgtggggaagtaaatttctgttgtttgatttccctggtccacggtactttgttacggtagccctagcaaacgcacatctaaacctcgtgagaatcaaatacattgctactaaaatcaaaagcaaatgaacaaccaactaaccaacaaaaagccccccgaacttgatagttcatcctgatgtgtattggtacctctgatttaattacatattctaaatcctattgcccttttgaaatgcaattttaaactagctgtggtatgatactccctctgtatgtgcattttcttgtttacttaaaaaatagtggactcccttgggggatagagatgatgtccttggctccctgtgtgtcaccaccacatacaacaaatcagatggacgcagcaatcctctattgttcgatatggatggagaaaggaacagatgagtatgtgagtcacagcgtgttacttggtttcatctctggagtttacagcctcctgtgagaccaattctgtatggagacgcatttgtaaccttacctaaatgagcaagcaactggtgtttggaagaatgcattctaatatttcatggtttagtgcccctagcttacttagaaattttgcttctatctagctttcttgtagcgaaggtagaaggtgcccgtgtggtccttttagggatgatctgatggagccgtgtaatctgctttcttcaggtgcacgtctcatcttgaatgccacctttcccctgatacactccacctgcccactcgtgttcagcatcatctccaagcaccctgcctcgttcctctgtccacatgctccatggttttgcatgggtttttctgaacctgcttctgcagcaaagctgccatctatctaagacgctgaccctttttaataccatttttctaaaattgacaaattaaaatggtatatccttattgtatacagcatggtgttttagtatgtgtacattgtgaaatggctaaattgaactaattagcattgcatgacctcacatacttaccttattttttagggtaagaatacttaaaatttacgctctcagcagttttggggaatataatacgctgtgattacctgtagccgccatgttgcacagtagatctgatgaactcattcctcctgtctaagtgaaagtttgtattatttgaccaatatctcctaaatcctccagcctccaagcctctggtaatcaccattctactcttgcttttatgagtttaatttttttagacgctacatggaagtgagttcatggggtacatgtctttctgtgtaaggccctgatccttatgtgtttttcccccacagtaacttgtgtaaaaccctatacccagagaataacaaataaataacaacaaaaaaaaactattaccaattgaaatggtttaattcactccaagggggaaaaaagttttgcaaacatctaagtcacttcagagtgttttgatagtatttgcatgagaatcttaaagcctatagtcattaggcacaaacaaatgctaagcaatgcacatattagtccagagattctctttaattcacacttagagaaaaagggaggttaagagttagaaccatagctaattgtggagctgggaattgaacccaggtctatattcacttgttttgacaaacatggtacgttaccttgatgtctattgagattgccttagctcaaggtaagaatgcatttgctttttagaaaggagctaaaatgatcagtcccattgtgaggctaagatacgagaagggtatggttttctttattgatttggactttggggttagacctagcattgaggcccaacctttgtaggatccaactatgacaggtggaaaatgcctcccctggttagttagaaatttaaatagctaccaaatgagctgagtattttatgtgcaaagttttaggtgctaccagttaaattatttaacatctaccttcttgaccctgactcataaagcggggggtgtttttgttaaaagtgtagacaatttcccaaaactatagcagcaattatagaaatctatgtgttctaatttaaggtccttccacagtcaggactgaagtcactgagtggattggtggttgaaatcatttcttctttgtatgccagggttttccagggagaaaagtgaaagaaaacacaaaggtttggttcaataagaggagcacttgatgtcaactctgtcttcccagccagtgagtggcagaatccttctatttctagccatttacttattttgaacccagaccatttattttctaaaaacagattactcatgtggtagtttatataccaaactgtagaatttttcattccaaagacacatggaaatgcctctttatgctcctaacaaacagtaacagattatgcacacagagcatctactgtaagtaaataataataagttaagctgaagggacacacacagaatctataccaggcatatctgaaggggaactcatatgccagcggcagccttccatgcttgtgacatgggcccggagaactgaacaggtgatcctttcaccaaacccagagggtgatcttgaaaacttaattaaagcagagttcttccaggcagccgaaattattagttcagagttggtactcatgttgaaatctgtgttagttttttattgtggccctaacaaattaccacaaaaaaaatagtggtttatagaacacaaatttactattctgcagttctttaggtcagaatttcaacaagaatctcactgaagtaaaactgaaatgtcgccaaggctgtgtttcttttggaggctctaggagagaatccttttttttttttttatcattctgattgcagtcagagtccaattccctgtagttgtagaactgaggtccctgttttctttttttgttttctttttttattttattatattttaagttttagggtacatgtgcacaatgtttaggttagttacgtatgtatacatgtgccatgttggtgtggtgcacccattaactcatcatttagcattaggtatatctcccaaagctatccctcccccgtccccccaccccacaacaatccccagagtgtgatgttccccttcctgtgtccatgtgttctcattgttcaattcctacctatgagtgagaatatgtgttgtttgattttttgtccttgcgatagtttactgagaatgatgatttccaatttcatccatgtccctacaaaggacatgaactcatcattttttatggctgcatagtattccatggtgtattttactgggtgtgagctgagggtcattcctagtgtctagagggcgccattttttttttttttttttgtaattcatggctccttccttcatctttaaagccagccatggtttcatgaatcactctcatggtttgactctctcgtgcctcttcttctgttgtatctgtcggactggtttctctcctgcttttaagggttcatgtgattacgttgggtccacccagattatccaggataatctccctattttaagatccgtaattataattccattggcaaaatcctgtttgccatgtaccatagcatacatagatctaagatcagccagccaagattgtcggtccaaaatcatgccacactagttatgtagtatccccactctaagtagactgattctccatgtgtattcaaacactgcagacatttgatttgtgttctgggatggtccacctccattttcatataaaatatagaaagtcagagaccagagcattcagaactaccatccaaggtagcccagggtggccattggcccaggactcacctctacctgccttttgaacttcttcttttgcagtccctactggcattcattgcttcaccatttaagtccagctgttacaaaagaagcattgttagaatgtctaccataatagtactgactctttgatactattattattattattatttattattttgagacagagtttcactcttgtttcccaggctggagtgcaatggtgcaatctcagttcattgcaacctctgcccctccgggttcaggagattctcctgtctcagcctcccaagtagctgggattacaggtccctgccaccacacccagctaattttttgtatttttagcagagatggagtttcaccatgttggccaggctggtctcgaactccagacctcaagtggtccacctgccatggcctcccaatgtgctggggtttcaggcatgagccaccgcgcccggcctgatactattttattacttgatagttctgttgatttctactcacgaagtgtgtcaagtaaggtaatgagaatgtagaaatgtaaaattattaaaaccagaagcatttgtatgtgtcacttaagtgctaagtaaaacacatgaatgaatgagtgaatggatgtttctaaagactctaggagatgtctgtagcagatggcatcagatccctgacattattttatcacccactcctttatgtcaaaagctggctatgaaaaacacctatgaacctatatattttttaatcctttaatttatttattttttaattattgttttttaagttccaggatacatgtgcaggatgtgcaggtttgttacataggtaaacatgtgccatggtgttttgctgcacctgtcatcccaccatctaggtattaagccctgcgtgcattagctgttttccctaatgctctccctcccatcagtctccccaaagaggcccggtgtgtgtggttccccttcatgtttctgtgtgttcgttgttcagctcctacttacaagtgagagcatgcggtgttcagttttctgttcctgttttcgttcactgaggataatggcttccagcttcatctatgtccttgcaaaagacatgatagtgtgcttttacactgaacctcttcataagggctatttttctggctatgggacacattcctttcacggcctgggtaagcaagaagcatcatggaattaacaaccctggaaaaagcactcaactgaggataaatggggacttagtggatcgtgccccagcttcctcatgcgctagagtaagtggggcagcatcgaggtgtgttctgccatctcccagagctctacaatgggattaagccccagttgcccatagtgggcacttgctcgttaacaaaaattgtgttcctcctatccatgtctcaatttccattccccattgatgttcccttacatcactccaaaatgtagaatttgcgcttgaattttaccccagctctgctttcagggaaacggaaactaaaatagtacattcgccataatgagaaacaccatagcctaataattccatcaagtaaggttttctgatcagtggatattctcatcatcatccttttgccatcagtcttttatccctcctcctctttttcctctcttgcacagtacatcactgctgttgtaggatgtggattcttggattattgaataggtttgcaagcaactgccgctgtgctcatggtgcatttcccaaaagttaaaaaacttgagtttggctcactgagcgatcagagcacgaggttttgatggcacagtgtcttgctcacatatgaggagactgatgtatttgctgccacattccactcatttatacttgcctcagtgtggtttcttatttgcaggttgcttttaacaatatagatgctttcctggatagagaacatggaggcatgattttggaaaacttgtctgcctcagatgcacccacgcatacacagatatatgcatataccgagtattctgataacaacttagagatttaaatatttttggcaattttgtggtgttattttcaggggttgtatattcttaatcttgattgcatatgtgtcttgacatctttacgccaaaggcatgtttttatagatgtctgaattaaacactgaactcttttcaagatagctgagtttacgtttaagtggttttgattaacctgggtttgcttatttgctcctaaatgttctaatgcagagccatctcccttggcatgaagtgatttgggagcacagctttagtaataatacttttctaagtaggcaagagcatcctgccctgaatgtttcccaaaactggccttaaactgaagaattgaggtttagccatcccccttccccttagccattcaggtggtgcggattgggaaactggaacctaactgcacagacaccaaattgaccaagggtgacaaaaccagcactgacaagactgtggttgttgggtaggtgaagggttcatgagctagtaagcaggactcagcttggaatttggaaaatccttagtgcaagcaattttgcccagagtggcatgttgtcaagttgtcctcaagctacatttgccattaagagaaatgaacttcaaaaaacagcatagcccttcacaagcctatctttactcaaagcctgagaaaggagggtcccatctggcttaacacattacaatttcttcacaagtggagcttctcggctgctaccctgaagcttccgttttgactagtattggttcttaggtatcacagaggaattagattattctaaaagcttttattgagcatatactacatacaccactaggagaatagtaatgtcttgctctcaagggctgtgcattctggtaggtggtgtgaaaaggtaggtatatgtaattataatgccaggaaaaagaaaatgcgatttgttagtcatgaaattaggtgttagaaaagcgcagaggagagtattattacccctcctagcctcctagctgcaggaagtgtggcagatcatttaaaggatatatatgtattacatacatattatattttatgtatctgctaattcttggatttttgaatagatttgaaagcaactacaacttgatcacaaattgttgttggggtcacaactgaccccaacactaatttgcccagatatgtgtgtgtgtgtgtgtgtgtgtgtgtgtgtttgtctgtatacataacctgggtaatttatacatacatacatacatacatatatatatattttcccagtattgaaatactacctgaattctaggtccctatacacaaaaagttactgtttattttaacttaaatatcacttagacatcttaaacttcatatacccaaattcacactcatcatctgtgtcttctacacacacacacctgcccattaatctgctcttcctcccttatcatgtctttttacaacagctcctaattcagttgttgagaccagaagctcagctgttgctcttcactactacatctttttcagctctaccttctcctttagatttgtgattcctaatatctcttaagtctatgaattcctctcaaaattcactctcgcaaacctactcgaagtcataacgatttctaaactagattatttcaatagcattccaactttctgacccgttctctagtctttgttccttttacggtaaacatgtatcttgagctgcctggaacaatagtagttacaactgttgtcctggtataattattaatagcactttcttctttccccagaaagtcctggtttggagaataaattatgatcactgaaccttctattcactccttagggccagaatgacctttaaagagcttaattaatgctactcttattcttcattcatcactttcattacagtgcttatcaccttccttacgcttacccacaatctgttattccctcgtttgttttgtggtttacttggtcatggtttctcgttctcctgtcttcttactccctttagattgactcctcttaagggtaagagaatgcttattttgttcttaactctactctctactgcctataacatagtagaaactaaatattaatacatgtttgcaaataccagtggctattgttttttgttgttaatacaatgaaagaatcagtatgcaccaataacataatctggctacaagataaccgttattctagaaagctgccctaggaagagatttcagaatatttcagaggatcttctgttttttgccatgttagaataacttgtaccataaacaactttaatactggacaaaatatatgaagcatcattttcaggcaatgggtacaaagcagcacagagctgtgatccttcagagaatcggagacatgtgagatgaagctaccgttggcccagttttattcctgggaggaacgtcttgaacataagtgctctgagatgaagaatttacaagttggggatgaggaagtagctggaatttgtggaaccggttgctacagaaaggacagatctgtgtgggaaggagaagtctccatgccctgagttcttggctgaggaataagccacttatgtgcagggtcaggctttgtgagtcctcacagggagggttaactgtgacacagaggccagggtagaggtagtacaggttgtaggtattcagttgagactccagaaagatcagactttaggagtaaagtgtgtatcttagggcaagggtcagcaaattatgctctgcaggcaacatctggctatgggctgtctttgtagtctgtgatcaactaaaatgggttttagatgattaaaacttaataatatgtgactgagactattttacctgcaaagcctaaaatttctactatttggctcttttcagaaaatgtcagccaatcccttccctatatgaaggggcatggcccatgactgtagacaaatcctaagaagatcttcccaacaaagcatgaaaatgagctttacagggtcaagagcatgcatgagttagccgagcgctgccagaacaaaactcaaccaccatttaaagaaagacgatataattcagaccccctacaattcgttctatgtattgaaatccacacaattgaaatgtccaatggtaaatgtccagtaatgataaataccatggctggtgtggaggctcacacgtgtaatcccagcccctttgggaggtcgaggtgagtggagcacttgagcccaagacttcaagaccggcctgggcaccatggcaaaaccccttctctacaaaataataaaaaaaaatatatacaaaaaaaaattacacaggaacggtggcacatgcccttggtaccagttactcagggggctgaggcaggaggattgtttgagcccaagaggtcagagtgagctgtgatttcatgactgcactccagcctgggtgacagagcaaggcattgtctcataaaaataacaaataaataaatactagatgtgtagaaaagaaaaaaaaattgactgacaatccagagcagtgtttggcaagccacagtttatgagacagctccctgtttctgtaaatattcttatttcattggaatatagtcattcctatttgtttccattttgcctatggcttcttttgttttgtaacaagaaggttggacagtttcaacggagaccatatggcccacagagcctacaatatttgttttctgtctcttttaaggaaatgttttgtccactgattaggagaaaaaacagtcagtagaaagggactacaagatgacccaaatgttaggattgaagtagacaaggactttgaaataactgtttgaaatattgtagggtttataggaaaagatggacatgatgagttcgcagatgggaagtctcagaaatcgaatgaaaaccataagcaagaaccaaactgagattctgttaggttgatgcaaaagtaattacggcttttgccattaaaatgataataattaaaataatggcaaaagctgcaattattttgcatcaacctaataaaattgacagtacagtatctgaaatgtaaacatcagattgtaaaatgctgaatacagaaatctgttaacttgaagacagtgaagaatagaactaaggaacaggaagaagaaaaatattgaaaaaaattgaaaaaagcctcagtgatttatgggaaatatcaagcatttaaatacatataattggatttctgaatggagagaagagacagacaatgggacaaaaaaccattttaaggaataaaagctaagattttccaaatttggtgaaaacatcagcttatactccagagagcatggggaaaaacaagcagtataagcataagaaaaaattatacctgaaaacattataaagaaatgcttaaaaccaaagataaacagatgcattttcttttggaaaagagatctatatttgtctattgcgcaacatatctctgtaatgagtacaggtaactaagttctctaaagccatcccccagtgagacattgtgaaaacttctgggattggaaatggtgaggttgggaagaggtaggggagctcattgagagtagaatcaaagggaagtcaaagggtgagaattaaagaaaaagagaaaaaaggggcaaaggaactccccaaagcgtaaaagcaacatacggcaaattcgatagtagccaagatgaagttctgtgttatttgaaatgtgtactcatggggctgaggctgtgcagttgatcttactacagacaagttggttttgttctgttgcataggtacagactgcagtgatgttgcatatatagggaatccacttctgggtaccaacagtaaaagtgcttcattgctcagtgatgatcaaaccgtcttcaaatgcaagcagttattggttttagttaacaattatttatagagcactgagaggttgcccaaaagaactctaggagaagagttgggaagtcaaaaactttcagttgctgtgttgccttgtaacagtgtttgttagcatacatgattaggggaaagaaggataaaacagttgcaagtatttaataatctggaagttttacagaaatatctagattttttttggcttctctttaaaacaataagtattaaaaaataaaagcccacacaactttgggtttgcatttctttttattttttcttttttttatttatttttctttttttatgagacggagtctcgctctgttgcgcaggctggagtgcagtggtgcgatcttggctcactgcaaggtccgcctctcaggttcacaccattctcctgcctcagtctcccgagtagctgggactacaggtgcctgccaccacgctcggctaattttttttatttttagtagagacgggatttcaccgttttagccaggatggtcttgatctcctgacctcgtgatctgcctgcctcagcttcccaaagtgctgggattacaggcgtgagccaccgcgcccggcctgggcttgcatttcaacatgtaaacaatttcctgtaactgaataaccatggctttatttgaatgaggcatactacactttgccaccgtccttgcacttccctattagtcccctaaactgacaccagttgtcagtttctatttatcctcacacttgggctttttttttttttctttttttttcgagacgagtcttgttctattgccaggctggactgccatggcgcgatctcggctcactgcaacctctgcctcccgggttcaagtgattcccctgcctcagcctctcgagtacctagaactacaggtgcactacctgctaattttttgtattttagtagagatggggtttcaccatgttggccaggatggtcttgatctcctgacctcatgatctacctgccttggcctctcaaagtgctgggatttcaggcgtgaaccaccactcccggccatttttttctttatggtagaattaagtagaaatgaaatcatttattttacccgagtctttgtcaaaaccagcaaaagaaaagaccaagaagagtcccatgcttgagaaaaaagttaagaaaataggatataccagatttcttggtggaagtgtaaaatattttcatatgcctaatatacaaaaaataatgccatatcccttctcacttgactcaaatggaacacctgtgggatgcctgcagatacttgaatttcttcaaattactgctttagcaaaactttatttttgcacatgaaatttttttcctcccaataatataccatcatactaacaaaggttaacaacacaaagtgtaaacaattctaaataccaccttcccatttctaaccaagatgttcactcgtaacagtgtatgcataatatgaaatgaccagtttaaacttccattccaatgtcatggtttatatgcccactcatatacctcctgtgagccctggggataatgacacagtttcttgtacaatttaagtggtgtcacctctctggagaccagtgaacagactgctggttgttgtcttagttaaacacttactttctaacaattttctaacattgcatttctgaaacagcttggaaatgtgcagtgttattgggtgtacgcgagagaggtgggcaaagacatccatctgatttcttggaacagggccatttagttagtggacgagacctcagaggttttctttgcacagacttctcctgatgcacttataattttctgcccagaaatctcttcaaggcctgtggagttttagctctgggggaattattcctctgaataagcggtttcccagctgcgcacataatgctccaatcaggctagtctttgttcagacaatccatgaggggaaatgttggcattggtgggcaaggtactgttagccccactgtctcaaagtacatcggtgatgtccatgtgtaactgaccaaagtaaatgcagttttgcaaactgcaatgagttttacgtgatgaattttcctacaaaagtcaaaatgggaaattcaggttagtgtaggtggtgaagctactacatttattagcatcaaaagcacagagtctcaaagacgaactaatctgtgaataactgtgccattagtaagatcataaacatggactaatggggatatggtacagtgaaatgctggtatttgcagcctgtcatcatattagtacaatgatgaaatttgctgctaagttcctcagcaaatgttcagtatcatgtttgtgcctttttgttataatttgtaccgtattagtagcaacttaccatattagtgactttaaaatgtttttaaaattatatctgtcgggttgatagaaatggaatgttctggggttgtgcaagtattagtcgtattaaacttgtcctgttagcagctttcccttgaactgatacttaaatgaggttttgatataaacaaaatgtgcttctgagatgtgcttccagctacaaccaatttctcccagtccattagctactttgtatcccttttaagcaacttgagattgtgcttttattgaggagccaaaatgtttgctcaactcattaggccaaacagagagaaagtaaactcaagggctgtgctgtctcctgagttactctggggcccggtgaatggagcattacctccatcactgctaagacagacaaacaccttttgagattttcctgcctttgcctctctctaccacttgctcctcctcctctttggctcatgagaaaggctggtaactccactgttcattctttctcatctttagtctctggatttcaaaagtcatcgttttcctgcagaagaaggagaaaggagcattgaataggcaaaccagctgatgtccactatacagagttttttggtgttagaaaagctggtttagaaaccaccttaggaagtgacctaacccagaaatggtttatctttgtaaaatggctttctcttgtttataaccaaccccatatactttatttatttatttagatggagtgtcactctatcatccagtctggagtgcagtggcacgatcttggctcactgaaacctccgcctcccggattcaagcggttctcctacctcagtctcccgagtagctgggattataggtgcctgccatcacgcctggctaatttttgtatttttaggagagtcagggttttgccgtgttggccaggctggtctcgaaaccctggcctcaagtgatccacccactttggcctcctgatgtgttgagattacaggcatgagccaccacacccagcccgaccctattttttattttatcttattttatttattttattttatttttttttgagacaggctctcgctctgtcacccaggctggagtgcaatggcatgatctaggctcactgcaacctccacttcccgagttcaagcgattctcctgcctcatcctcccgagtagctgggattagagtaatgtgccaccacgcccagctaatttatatatataccttttttttttttttttttttttttttagtgaagatggggttttaccatgttgtccaggctggtcttgagctcctgacctcgtgatccacccaccttggcctcccaacaagaccctattttcaaatgaggtcatattgtgaggcactgggagttagggtttcaaaatatcttttttggggggaaacatggttcaactcatgacagcctgaagtctttatttacgtgtatctatcccatatggtgtaccattctcaatcagcaggagccatacattgtctgttgctgtaggattataatcagactcactgacttcacttcctatctctgcaccatccaggcgcgggactgcatatgtttattggccaaacccagttttacttgctcatcatacatctggctctgccccaactggagcttgcaaactgagggttgggcaggggaggtttgttaagaggagaccagtgcatgttcctaaaagaaggggagcagaggaaaggtatgctgagcaggtacaacaaagaaaacacagaatgcttcatatggaaagttctgcctgagcagaaccacagtttacactgtgtacctgcattttgtcatgcagcacaagcaagaatagagggagctattcagcaactcacagtccttctttgtcaagttcagattgtaaattcttggagtatttagaggtggtgtcacatctgtttctctccctctgtataaagaaaaataaaatgccatattgaataagtacctcataaagccttttgcgttatgatggagagacagccaggaagatgagagtgaaaagtaaacattttcctgcatggcaaatggaggcttttgagggtgcttgagatgtttaagctcttgtcttgatctaggtggtggttacacagggtggtgtttgtgtgtgtttgtcaaactgtacacttaagatttgtgtgctttaaccccatggttgctagtggctgtagggtgataatgggaagttattattaagtgagtgtagaattccagttttgcaagataagaaaaagttctgtgggtggatggtggtgatggttgcccaacaatgtgaatgtacttaatgcagctgaactatgcatttaaattagttaaaatattaaattcattgtgtatatatatatacatatatatacgtatatatgtatatagatgtatatatatatacatattatatatatacatatatacatatgtatatatgtatatatatataaaaccacaatttaaaaaagactagtatactttactatatcaatattattcctcagccaaaaagtaaaagtaaataaaatgtcccattcccatttgtttttgggagtcacaagaagggttgaactgacctctgatttcatgcagcgtggacaggcaattttagggatctttactgcaatatctcagcagatagctgaacactggcataaatagattatttcctccaatgccttgcctatcattctgtaccttcttcggcttcctaaatcctagcaacaagtaacctgtctttatcctggcagaacggtcttcactatgatttcagtgccaaagtaatgactgtttgtactgaatacatgtaacagagcctcattccttagggaatgtgtgtttttccccttcatgtttgttataaagtttgcagatcaccatccctgtagtcacttaagctctctgacctgttcagagattcctcagcaatttgctctctgggtatccttttttcatggtccatgttctcttggggtacactcacaactttatttttctagctgcatgctgccattttgggattggctgccatatgaaccctgggtgttagggtatgcttcccatcacagatgacattgaatagttcaaccctctccatctctcctcttgcaaggtatcatcatcattcattgcgtggaagaccacaacaaactcttgactggccttttcgctgtcactttgcctcaaggccacaatccatcctcaggaccaagggagcctttgaaataagtcattccctccttgacgttcgttagcagtttctcattgcttgtggagcaaaacacagatagcacctttagtaactaaagctctgcatgaactggtctttacctcacttcccctcctcagcccttgcgagttgctggccgtagccacactggctttattttactttttttgaggcagagtctcactctgtcaccaaggctggagtgcagtggcacgatgttggctcactgcaacctccacctcccaggttgaagcgattctcctgcctcagcctcccaagtagctgagattacaggtgcacaccaccacacccagctaatgtttgtatttttagtggaggcagggtttcgccatgttggctgggctggtcttgaactgctgacctcaagtgatccaccagccttggcctcccaaagtgctgggattataggtgtgagccaccacgcccggcccacactggccttattaacatgcagaacatggtaatagtgttcattctactaaacctgtttgtgtgtttgtgtcctaaactttagctattataacttggccactcctcatgggggaatcaaagggaagctgttcttggctttagagaaattcacctcccaaggctagaaaaatagaagcactcatttctcactaatgatgggaatgagagtagtgggagtttttatatggaggacattatttatgtactttttaaattaatttgttcattgactcagtacaaattgatcatctcactacacctgtgttgtatatctcaagagttgggtagtcaagtgatagttttattattgtctatatttcataattatttattttaaatatttcataatgagtaattttttaaaattatactgatcaccctggccttggtaacatggatgatttgaacacctgcctggagaatccaataataggattgctcttattgatgaactaatatgtttaaccatcttcctgttgaggtcagtctttttagtggcataaatattccttccaggcagtggagtttgggataatgtagtagaaattgctggagtttctcctaaaggagaagaatctgtgcttgctcctgtggccacagagatcacaactggaaatgagcagccacgtggctgaaagtggaagaagcgattgaattcctcccatcctctctggttcatagtgatggtcggtggtaaccaccccaatttgcaggatctgggagaaccactctggagatcactccttggtatcctaattccctgttatctatcttggtaaactccagccttctggttggatattttagctactgcaacattgaagacctatggttcaggatgaatctaccttctcaggagcttcagttgtacagaatacattgtcaagtgatgtcctgtaaacacatattaaatgaaggttccaggctgggcgtggtcgtttctgcctgtaatcccagcactttgggaggccgaggtgggtggatcatttgaggccaggagtttgagaccagcttgggaaacatggcacaaccctgcatctaccaaaaatatcaaaaattagctggatgtggtggcatgcacctgtggtcccagctacttgggaggctgagatgggaggatcgcttgagcctgggaggtggaggttgatcaaacctccacctgggtgacagagtgagaccatgtctcaaaaaaaaaaaaataaaaattaaaaaaagaaggtttcagcactgattcagttgagtttatcaagtcatttttcacatttcgttcagtgtttagtaacacaactgtttaatgaaggcttgcagactttctttcataaagtttaaagttgtatgctgattgctgtatataattaatgtatcacaatggcattcaatttctgtagcagatcagaagccactgaaacagagaggccaccagtagcttaatcagtgttggtttcaggctattgctttgcagttgattaattattgtgttgagttgataactgataactggattaattattttaaaataatttctcttgaagcttgacaacaagagttgtaaatgtttccactgtgaaagcagctctggacctaccagcctgcttgtaaatatggaaaaaaatggttttgaattgaatatttgaatatatttactttgttattaaaatgatttaaaatggaaggttttgggagtgacaataaatagaaaatgtcactctgctcatttcaaggaacaaggtttgaggaattgattgaatcatcaatttggttatgagcagaatttaaaacatagaaataatttgctgacaccccccgaggggacagtccacggaatgttccattccgtctgtttaacctctggactccagagtacagggattgtaacacctcccacacttgattaatgggaaacagctgtctcctgcttgtgtcacagtgataaaatgtttctccatcttagggcgaatctcattccttgcagagggaccacatgttcaagcaggtgggagaatgaatgggtgcaaactgagcagaggcaggaagagcataaccaggggactcatttaggctcacagaagcttaagattaaatataaaaaaacaagaaatgacacataccaatccactggtgtatcagaggccatgaagtatagcctgtgtacacccctcaccgtggatcaaatgggtttctttgttggctttctcagagcttgtaagagaactcagtctgctaactcagatgcacaagaaacaacttattacattattcatttttaatcagtttaattttaaatccagattcttatccctatcaggcaaaatgttcactttcagctatttcactcctttcccttttcctagagatgggcaagagcctgggagaaggtagtgcccagaaggcaccgtgcatgggtcagttgttagtggttgccatggtgacatttgctttcaggtacacatagtgcatcttggcttggtggctcccttggttctctaccatcctgaggaatggtgactctgtggtgaagctaggaaccctatcacttagcatcctgcccacctagaggtaccatgcagctgtttttttcctgggacccagagctgtttgccccgctcacagtcttgataccctgtgacctgttaaaggccctaacactctcctgatcatctttcaggtcatttaccctaatcccacccgggggcttctgatcaaacgtctgcaaagcatgggcaaataaatgtgtgggacagacctggtataatacaatcaaaatatggaaggactgtggtaaacaggagagcatgattcaggtccaaaggcattcagatgcaattaaatataacagaacactgtgctggtcaaatggactatatatgtatatatgtgtgtgtgtgtatagaggtatgaactaatatatatgtatgaaatacatatatacacacacacttatatgtgagggagtagtggaggagggaagaaagaaaaaaatgtggatagaaaaaagcatattaatatttgaacaaataatcttgctatgtacacctcgaagaggaaaaaagaaaatgtgaatttgcatggacctagtaatgtcttacttagagagatccattctttcctttagctgatttcagaaggccacttgtgagaaatagtgccccatgcagcaatgccccaaaagaaaggggaatgtcaaggtgctgcctcataactgacttcagtgactatgtgagaggtataaaggatttcagaggtggtgatacatttcttcaaattgagcttcaaagaccagaggctgattggtctcctgtgctcacttgccctaagtgaaatgaggtttctccgtaatgtagaataggtgacctgtaactctcattgcagaaaatgagcattgagtgaatgtaaaatgtacacacaaccatgatgtgttcatattcccccctctctcatgtctgtctgtatctggcaatcttgtctgtctgtctgtctttctgtctatctatctatccatctatctatcttctatccgtttgtccaaccagccattcagccatccatccatttgtccatccatgcatctattcatctatctatgtatctgtctgtctgtctgtccatccgtccatccatccatgcatcccactaatatgtcagtgtcttactcagaatggaaatactgaagataaagtaggtattatattgtaaaagttctatatgaacgccgtatctaaagttgtgtgtgtgtgtgtgtttgtgtgtgtacttacatctcagatcaaataaagaggctacaaacataaatgcctccaagggccaggcctataaaggaaaattggttattctacttgccaaataacatctgattccatggattgatgcaaactagagaactggaacatgtttgtcacctaaagagaacagctgccactcagcaccggctcatggttatcactttgaaaatgtagaccttaccttgctggatcagccagtacttcaaaaaaaaatatatatgtgcaagttatttgaaatctcttggtttttaaatattggcaaataagttatgtttcaaaaaagtatcgatatattggccaaatgaactgcaccgtcagggtatttgctggcatggatttgaccgattcaccaccactgcatcccgggtgcctccacagagatagatacagagcacgtgttcagtagaatatttgtggaatcaatgaatgaacatatgcctgcaaaattttaaagagtagggtgcttagttatttttccctaagttttcctatcagaaagggcacattttgtccctgtgcaaattgagaatttgtggggatcatgtccggaggtgatctctgtcaccggaaaccataagaaagatgaattttcggttttttcttcactgtaatgacagagtgtgttcagaacttctcccaagtaggagaaagcaatcaatcctggtttgttcagatggtcctggttttagcactgaaaatcctgcatcccaggaaaccgttctgccccatcaaaccaggatggttggtgattcggttcttgatgctctgtgctgtgattcatgggctctaaaatgtactaagcagattggtcagtgtatgtgcctgattgagaacttgtcagttgagggctgtgttgttattttcttacctctctgagatagccagctctgaggctgtctccatcactgcttgttttatggcatggcttggtggtgattctctccatcatgcttagccagtatgcatcttgatgggactacctataggctattttaacaggttactcgccacccgtctcatgctgccaatgattccacagtttacctaatgctttttaattgtttaggttgacattttgccatgcgcagttgtaggtaaaaatttaaatcaacaaggggctcggttaagcagttttctctgtgtgccatgtaaaaatatcactaatggtcaaaactcagacctgagcaagagataatatttccccctctccccttctgtacattgtatgttttaatattaatttcttctttatccatatatcaataattgaacactgcatcaattaatatgctgggcaaattgcattccccatcctctcattcatgatgtgtttcagtaatggagataattttcaagataaagcatacaatttaaaatggattaaaaagaaaaactaataaaggaaaagtgatttatagaaaaaaattatggatactttcaggaaatcttagctgtgcttccaagccgatggattttgtaaggagagcctattgaaacgatcaagttttatgcctgctgcaaaatttcctaggtctgcgattgcaaagagagggagggaagaatgtatacacacacacacacacacactttaaaatttggtcttctaatgagggcgtgtgtatcatcttcatccttagattaggaagccacagattcatgctagcaagtcttcttgaagctttccatttgctgggcttagttggtggggcttggttttttgcttttgatttgctgaattggcacacaggcttctgacggcccatcccccggccctccttcccttttcccggtccacaccctggctgagagccctgcacagagatgggcaggcggcagctgcagcgatgggcaggaccgcagcctctgagcccgcaatgacaccgtggcgtcggtagatggctgtagacaagtgtgctgagctgtgcggtgtgaagagtaatgagtctggggaggccttgacctgactggatgctgcttttatctgaagtacatttaaagagataaaggggaagccgggttgctgcacatgttcttttctctgcggctggagctttactttgagtttaaaaaaattctcagatgctggcctcccagagtcaccggctctgtgcagatgggcttgcctcaagaggatcggccgccttcctgtaaattccaccagtggggcttccgtgaatctcccacccgccatcaggaaatggtgtagtgcctgtctgttgatgatcaacaccatcgctagtattatgaatattgctagtatcatcagtttttgttttcgccactgtggctggccgcctaaagtgtctggatttgctcattaaacagccaaaccaagaatttgttacctaagcaggcttgacagaaaagagaagaagggcaagagttaggaagggaaaagagagagagagaaggagggagagagggagggagggagggggagagagagggagagagagagaggcagccagaagcaagtcacatcacatacagtgccactgaaggaatgttatcctcataaactcataaacaagcacaccaaatcttgtgtaaggaaagaagagggtctctaaggacttgacaggaaaaggcaagattttctacccactgctttcagtttttcttccagatactcttggtgaagtaaggagacttctgtttgctgacagagcccttgatttctctttcaagatgatgatgtatttgtgggtaggtagtgtctcttcctctgtctctctttctctttctctctctctctcgctctctctttctctctgattaataaattgactttggggataaagattgcagcccagagtaatcgcattttgtgtaaggtgattatacttgtggcagaataatcttgcactggtatagtacatgtgctcgcatttccagtgggagttcaggcaagacctggttcattagcattaagctgcaattttattttcagttgcaaaaaggaatgacaaaaaaatgtgtatgtgtatggggtttggggggatgtacggttttctgttttttgaaaacattgatggtggtgaattcagaaaaaaggtctagggaagtcgggttagacatgaagcaaatcctacatcacttgtagctgtgaggtatttcatttaattaccaagaatgaactgctctgagtagtgatggctttgtttatttgttttgtttttgtttctgtttctctctcacaagtgactacttatttgtcattttggggttgagtgctgtagaggagagtagcgtctttcatttgctttaaccagatgtgtgtccgtatgtgtgtatgtgagagtatattttacaagattggtcttgaaaaaggtagatttacatgcacttattctggctttctgataaatactctgtagttgttttttgttgtttttttttctggagatcgtattaaaataagagcaatgaagtggtaacccgtagttatgaattacaatatttaactcttgaagcaagaaaaaaatagtaatctagcatgaatggtttagaaaaaattacttattatgttttgggagacaaatatatatcctagtgtagtttagccaataaagagcatgtgtgaatttcttatgccagtaaccaaagtccttgctctgtgatttcaggtttagagcaggtgttccctgctttgccaagggagggaggcgttttcgaggttcaactcaacctctgtctttcatcagcatcatcatcactgttgtttttcgttgctcggcaggcttagaaaatcctctttatccgcttccctccagtccctgctctggttcaactcagatctatgaactctctttgctgtaaaggaagaaggcctttttgttgaattctttgttaatcacattggttctttgacctctgctggtctctaggtctgccttgcccctcagtgagccttgtcatttacacccttgccccctttctttgggacattttcctttgtagcgactttagctccatttccacccggtttagttttgcacaatttagtacaatgaattctggcagctggagacagagtttattattattttgtcttcatttcagggcaagttttctcttcgagcttgcgtatcacgaaagaggtattttgaaatataaaatcactagttaaaactgcatgaacttaatagagagttctatctaacaacactgaattctcataacatttatttttgacagtggaggttgaagcaattaaaattttgaatgtttacaaatgctgatttttaagcattaaaaaaaagtagtcacgtgggattgtcgcctcaataattaaggaaaaaactatactagcatttcatggaaaggagcctttttggcttttattttgtgaacagattctggttaattataaacaaatatcaataattcctttaggctgtggtgagttggttgctagtcacactctttctctgagttgttaagtagtgtctgtgatattatttatgaagtttgttagctcttacatatgtacatatttgcaactcaaagcagaggaaaaatgatgcgtgtcccagacccccttccacatccgaaaaacttgctgatttgtttcctagtaattaatcttgacttaaaagcagcatccctcaatttctattttcttctctcagaccaatgcattttagggctacatggctttattaactgcatttatcacattgaaaaatgggcactaccttcctttcctgtgctcaagtattctgtttacatctttaattcagattttttttctgcattcaaaaaaaaaatggcagagactttaaattggaacagctggatgcaggctgtttaaggagatatgaattagcaagctagcattaacactgtgaggttggaggggttttccattcttttcttcttcttcttttttaatgcagaggttctgctcttgccttctagtctgtaaataaagatagtctaaatgtggttgatatctctgtttaagagctcatcttgctttaggaaaatgagcctcagctacattgatgtgtgaaaatagtggttgctactgtctcatggatataaaagtgaaaatgaagagacaaggagagacaataaaatagaatccatattcagtttactcctgtcattgtttcttaaatttgtaaagtaacctctttatatgcacctatctgtgttaatagcacacgatttcagtatgtttttactaagatggaaaactttttgctggggggaggtgtggggtagatggtatagtctcccttctctagactgactttgtcattttagtctataaggatggtcctgtgtatttgaaaggtaaagaaatgctttggaatcgtatcaattaaaaatagtgtggccccattaagccagtccaattaaatagttacagatgcttaatatgtccatcatttggtgtcatctcagatttatacatttttttcccttaaatttctttaagaaggttttcctatcaaaaataaattttgtagttttcgttgtattttattttccctgagtgagtacaggttgctgtacaggggaaagaaagttgagttctctgcaaccattggctgacttccgggcggttttgattcaccaaacttggccacggtaggagggggaaacagccttccctacggacttcttggaaaagcagggaagtcacgtttactgaggatgtgatctgagctgagcaccaggctacacttgccgtagaatgaagtaaaaccctcttgaccagcacaacctcccttgaccagcacaaactcctgctctcctgtggttatttaattccgccaggattagaggttctttggaatacaattgagctgtttctcctagggctggaaagtaggcaattggcacctactcatctaattcacaaacaggatacaaattcctctgccactcaagtcttggaccaaatggtccccgcttaaactctactacaataggtatttgtttgactttataaccttttcgtttctctttactttttagttggttgaaacaaataactctttccattttattatttttactcacattttctcatttacattccaagtacacttcctctgtttttactttaagttaaaatactgcaatttttaattttaactttactttttttttttgttacaaatttggtgttccatttattcactgaaaataacttttcttcactttatcgtttcacacttcatcctcaccttttaaaaactttttttttttagaaatatcattttatacaaacatacctgggtttaaaatgggagaagagcaacaagtcaagtcaagaatttctgagggatgttgaaaagacggggagagagttatgccaggcggcagcatctctccttttaccaatgtagttcagtcacttaaaaaaaaaaagaagaaaacgaaaatgcatcattttttctacaggatcctgagagtcctctacctcccagagtgtgttacacttggcagaaactccaccacccagacagctccagttctcagcctgctgtaagcaaacttgtgaagtagctgcctgtggcttatctctgctctttcaccccatcctcagtactgggggagcctcctctgaattctgcattttctttcctgaatgctaaagctttttctgatctgtactctacattctagagcttcgttattaactgagtatagagatggcctgatttgtagattctatgtggatcagagattatgcagaagttgcagatatagagttgctttattgtcttggatcatcatgccagtttaatttaaggtctttcaggacagaaacaacatctgcccattttgtttgacattctcttttcccctttatttcaaacaatacacgtgccctttgtagtaaaattagtcaatgagaaaaaaaataaatagcaccacctcttctagcacctaagatatatgctggaacactggttaaactcttaaagatatttaaagacatcttaaagatgtttttataacatgcacacacacccttcttttctcaatttgaatatagcattgattacaaagttacaaggtataccactgttttattagtagggtttgttgttgtttgtttctcttgtttgtttctgctttagtgtgtgtttgtggagagccagaaatgctatcgcattaaaagcctgtatcaattgtaaaacacatctccatttcagatacattaaaatgtgaagaaggaaaaacaaagcctctgagaggaaatactctgtttcaaaaaatgagatcacactgctttagaacttactgttttgtaacctgcttttatcacttaacattttgtaccattcaatatttttccacaacagcctctttaatactgtatagacagtgttccagcgaatggcgattccagaacttatttaaccaattctttgattatcagttgtttctgcttataaaaatccttgctagttcctggtatggtgtgaatgcattcactaatcatatatgtatttgttcagtgggttggttattgacagagcctttacggacttgggcactgtctatggtactgcgccttgggggacgcacagttaagttaaaagtatgttaaaaggtatgaagagctgaaaacagaggattgcttgttaatattaatcacctgttgattgcagttcacaagtttggtaattattttttcttcaagtattctgtcccctttaccaaatcgaaggctgggacatccgccttttcacagtgattcttctttccgccttggtgcactggaggcctaagtgtcatctgtttttttccaagttagttgacgcattcgttgaatggttccttttcgtaggaacttgtgctggaaattgcctctggcagtcaaaggaaacatttttgttttggagagagaaattttcgttttttattccaaagttcagcatttctgtgtttcctatgagtgcagtgctttacagcaaaatgcctcaggaatacaaagatgacttcttttaccccagtgaattctgattcagaaattcgtttctgttgacctggcaagttcattcagcacccatactggtcaccgtgtatctcagttagggggctgagaaaatggcccagcagactctgattactgtgatgaaggtgttcattatattatcccttatctttcttgactgtgatgtatactgagcttgcctctcttgtctgtgtcaccaggagatagttcagagccctgaatgttctctgttgtctcgaatattccagccgccatgtttttcttgcatacccagcccacttcttctttgacactctgacatagtcacatctttaatgttgcttaaagatgtttttgaacatttggaaagggctagtttcccagcatctttaagtcagaggtacccacttatccagatactcttcaggcagaggaatgatgatggaccctcatgaacatctcaaacttctcgttgattagagggaaactggatggatcgaaagttaatgaatgggagctcatttgtgacttacatcttccccctctagcttaaccattcatggcctccccactcactgcagactttgtctggcagagggagtaatacgctattttccgcttgagcacccagaagctgttgatgtaaattgatcagtacttttttgtgttttcctgaaattctgtttacatgcacatttcctctttgtctgtaaagtgatttgtatcataaagccacatccattttttcccactgtaataatgacacaaaactcattgaatatttgtgtttaaagattcttggaaaacataatggtgtgactatataaggcgtatataatttttttaaacaaaacctggtgagtattaataaaaacaatgatgttgtctttatgattgtgttttaaacatagtaattggtcaagtggatgttgcttagtgccagaggatcagagcaaaacatactagatgtgaaatagcccttctcttcttcattttacattttgagtggtgtttcacttacctttagaaaattttccaaaccttcagacaaatacttgatcaaatgatgcgggtttgaaagacataagcaaattagtttctgtgcaaacttgtgtccccattcagagaagaacaaattgaaaaattgatattcaataccaacaagataatttcgggaagcaatagagcattgttttgaccactaaggaacatgaagcttttaggagaagtagagagagctttgcccattgtcttccatttattatccgaagacattccaggtgaaaaaaaacatgggaaggaaaggtaggaagagaaagctttgaaaatgatttggagacatgcaatgctatttcaagtggttctggggactggatagaatacatcattgctttctttgcattcctatgtcatcttctcctgatgttatcattcgaagtcagactgtcaaatcctgtgtattgggaaacactctttgttcccttgacttggggactcctgcatttcttttgaagttttttttttttttttttaaatcattacattgttcaccctactccaatgtcttgttagtggttgggtggtatggctaagatggctgatgaactgaaataagggcagactgtacagctgtgtgtgtgtgtgtgtgtgtgtgtgtgtgtgggtgtgtgtgtgtgttgagagagagagagattgagacagagggtaagagaatttttctgcttacatttaaataactcacttatggataacatttggataacgtgttctctttaatcacacagacttttgccccgtctcttaatacctgtagaacaaatattgtatctgtaaacatctattgtaaacatcagtgtaaacatcaaaggtaaacatcaattgtggaataacctttttactcttacagagtgatttgcaattctgttatttgcaaatctgtctatattttgttgatgatattagtaatttgttttaactagaatgttctttctttctttcttttttctttttcttttgagatggagacccactctgttgcccaggctggagtttcactctgtcgcccacgctggagtgcagtggcacgatctcagctcactgcaacctccgcctcccaggttcaaacgattctcctgcctcagcctacccaagtagctgagattacaggctgtcaccactgtgcctggttcatttttgtatttttagtagagactgggtttcactatattggccaggctggtctcgaactcctgacctcaggtaatcgacctgcctcagcctcccacagtgctgggattacagtcatgagtcactgcggccagcttagaatgttcttccttaatagaactcatgacaaaatgaaaacatgcttaatttttatctgtgatgtggagttgtgtgtcctcttttccacttggttgtttcttttctcttactttgagttacattgtgagccctttcacacaaagaagggtctgagctttctctatacttggatgtcatgatacataccaggtgggagcttggaatgtgtttacagatgataatcatgttggtaaggtcttggttgatcactcgataagtagcaatttgttttttaattcatttccttgttaagaaaatatggagctgggcatggtggctcacgcctgtaatcccagcacttcgggagaccgatcatgaggtcaggagatcgagaccatcctggctaacacggtgaaacaccttctgtactaaaaatacaaaaaaattagccaggcgtggtggcgggtgtctgtaatcccagctacttgggaggctgaggcaggagaatggcatgaacccaggaggcggagcttgcagtgagctgagatcgcaccactgcactccagcctgggcaacagagtgagactctgtctcaaaaaaaaaaaaaaaaagaaaagaaaagaaaaaataaaacatggagagcatctaatgcatgagatattgtgtgtgctaagttctgacgacccaggagacatgatatgatcccaatcttcatataacttacatgtagtgaaggagacagataaaacacaacacaataacaaaactggtaaccatcgagcaaaagtagtcgataaaagtgttattgctaaaactcatggttgcagagctaagtggagactcaaaggggatatgtaggctgagatatctgagaagtccaaagatgacaggcagtcagaaccaggtggatgcagatcatctcaccatgtcatggaaactctgactcaatttctcggacctatttttctccgtgtcccccagcaggatgtctgaggcaaccactagtagcttctggctgacatgccactgttaacagcagccctggtgggtggaccacactcatccaagaagtagtaggctctaggaaaagttttgaggccaattttcttgcacctggattgaattccttacctacccctgaacccatccctgatactcaacatccaaccctgtgtaaaatatttgctgtttggatctaggagtggacttagccccagtaaaacggggactgagttgagcaggttggctcatgcctgtaatcccagcactttgggaggctgacgcaggtatatcacctgaggtcaggtgtttgagaccagcctggctaacatggtgaaaatctatctctagtaaaaatacaaaaattagttgggagtgatggctctcccctgtaatcccagctacgtagggggctgaggtaagagaatcacttgaacccgggaggcggaggttgcagttggccgagatcgtaccactgcactctagcttgggtgacagagcgagactccatctcaaaaaaaaaaaaaaaaaaaaaggactgagaatagggaagtggtggtttcccaggaaatattaaagagctgttaccagaaagcgaaatgaatcctggtttggtaaaaacaacagatgcctcctatacaaataaacacatgtgatcatttgcaaggagatctaggacaaaaacaaaaaatgtgcttgggaaatgcaaccgcgagagaggtattgtgaatggtgacttcgagcaagacttttccaagaaggtgtcttctcagctaggacctgagagttaggaaactgctatgaggtaggaggatgctagggaggtgtggtggttagaaggccattgtgtacgtggaaattccaggaggctaggctggctcagcctcagatgtgaggagtatggtcagagagagagagagttctgagacaggcaggaatcagagcctggtagattagagttgcttgcatcaaccccagtatcaaagatccccatctcccatgcaacaccctggcattaaagcagggaaagagagaagaaccctacagaggaggacagtaagagagtgagtggagttttcttttctgttttaattgagaagtgttagagaattgtggaatcatttctttctaggattttaagcacctctccatctgcctcaaataatcaaattccatccaattagatgctgttgccactcataatatgcaagtctacatatgtactaaacccagggcctctctgcatctggttttgatctatattttcaaagaaacctgctccccaaacttgcacaatgattccttcacagatgctgagtcagcagagagctagtgcatatttatccagagattctgatgaaaagagggagaaagaaaaatctaaaagcagaaaaatacgaagtatatggaaattttgaggtttcctgctgagttagggagaaggggttggggaatccttgaataaatcatagtgcctcacacaatggcctgctttgtctagtaaaagcacttttggttgaggatcagaaatacaaaacagtttaataatagtgagtgttgtgaggagtttcaagaatcttcgagggcatttgacttaaatgagctcagtgatggagtattcaagtaaagccagtgttgtcaatatgctaacttaaaaggctaatcaaacaggcaagtggtacaagtgaggaaaggaacacaattagttaatggaagatggagggtaatatggaagggacaaaaagttttttatttttatttatttatttagagacagagtctagctctgtcatccaagctagagtgcagtggcacgatcttggcccattacaacctccgccttcctggttcaagccattctcctctctcagccaccagagtagctgagattacaggtgtgcatcgccatgcctggctaatttttatatttttagtggagatggggtttcgccattttagccaggctggcctcaaactcctgacctcaagtgatccacctgcctaggcctcccaaagtgctgagattacaggcatgagctactgtgccaggtaggcaaaaactcttattctattcattcatttgtaaaattaagccaaagatagcatactttactttattgaaatgtaacacacacacatcagcacccttaaacatatacattcggttataatgtattggtaataacacaggaaattcattggtttcttatggggatataggacattagagtggttaaaatagtgatgatcttggctgggtggtggctcatgcctgtaatcctggcagttttggaaactgaggcaggaggatcatttgagctcaggagtttgagaccagcctgggcaacatagtgagaccctgtgtctatctttaaaataaataaataaataataattaaaatcgtggtctttctagtgaggcacagctatattcaaaatttggtccttatcctattttttgcagtaaccctcagtttcttcatctttaaaatgggactgttactagtgcctgaggttgtttttcaactgatattgagctggttgcttatagccattggtctttttgattgatggctgcctctttttggtgggtcagtgtccaaactctctcttgttaaatagttcacaaactatccttgcatagtatctttctcaaacagttatggtgaaagtttatattgcaaaaatagtacttagaatcagagatggcagatagtagctgtttactaaaagttagttgtaaccatcaatactgttgtcattacaaaaaaactgagtacaaacaatgtcttctgcatacgtgtggatgtagaatgagggagggtagatacagggcaggagagatcactctagctgcagtgggaaatggctcaaaaaccaaggaatttcgtaattcctggctggtgtaaactcattttgtaccagcttctcctcgtaggatctttcttgggtgttttatttaacccctctttaaaatggggctaataccagaaggggaatgggatgaaataatagaaccatatttagtgtctagctgagtggtttgcactggtatgtgagactttatattcttctcttctcctattacttataaaccaacaagtatctgagacaagtctcagtcaacttagaaaggttattttgctgaggttaaggttgcacccttgacacagcctcaggaggtcctgaggacacgtgcccaaggtggttggggtatagcttgcttttatacatttagggagacatgagacatcaatcaatacatgtaagatttgcattggttctacctggaagggagggacacttcaaggaggaaggtgtttccaggtcataggtagatttacacatattctgatgggcaagtggttcgtagagttaccgggagaaaagaatgtgtgggtttcaataaagggttatggagacctaggttttatcgtgcggttacagcctctaagtagcaggttttagggagaatagactgtaaatgtttcttatcagacttaaagtttgtgttgatggtaatggtggagaggggtataatgaggcatgttcacccctcagttctcatcatggtctgaaccagtctttcaggttaaactttagattgccctggtcgaggagggggtcctttcacatgatggggggtgagggtggtcaccttcaaattttatttttgatttacatactaaataaagctctctggtgaagggaacaaaaaaaaaagctttagagagggatgcagagaaaacaaaattgaagttgaaaggaatttcgaaatttgtgtgttaaaggaatgactattcagtgctgatatcagtgttgtgaaaaatggttagaataaaatgctcatgaaaatttctctttttaaaaagaaccctgactctttctgaaaataaaagtcatatttggacattatgaaaaaatttgctatatgaagtagaatctgactccccccagcctatcactcatcactcaacatttttgacgtatttcctcctcttttaaaatatcagtatatttgaattttcatagatacccattttcctccaaaacagaatcatactataaacatattttcatacaaattatctcataaacattttctagtgttactgatggtttgggaaaacatgggtttttaaaggttgttttttttttttttttttttagcatatggctatactgtagcttatttacccatttgcctactgttggatgtcaggtttttcttgacatagcctgtgataaatattaatgaaatgaacaataacaactttaaaaatgtacaaaatggacaagggagagtgaacagaggactcagagggggaaaaaagatccaatggccgtaaatataggacactgtgttcaccctctccaatgtcagatgaatgcaaactaaaaatgtgttgtcaaattgagaaatgttttgcaaagggcaatactatactgaatgcttgtgaagttaaactgctaaacatttttagaggttgctttgcaagtacaagggattttttttaagtgaaagtgattgtactttatagcctcatcaaggattattttttgaggaaacactcagagatatagtgaaaaaatgttgcatacaaggatatatggtacaaagttacctatatacactaaaacatctctcaagttttcattcaaagaataaaagctagtattctcatgctatggtacttttaaggcactaaacgatgcctgccgttggttgctgagtattaatttagtcagagctatgcatgcaggcagagctggcctatgcaggccccatttttgtgactaggaatttattctgcaccagcgtggcatagagagaaaccgagtgagtgcagtgccagctcgccgctagcttggatgaatacatgacacaccattgcgcttggagaaaatgctattcattgaaaataaaagggaatttaggaagaaatgtaatactcatcagtaattgcaaggaaactcttggatttcgttccagagtcttggtaatagtggttacataatatagcagtgaatgtatgcgtgagattagagaattttagaaggaagaaactgagattcagaaagagaccggctgtaccaaagtgtatccaaccaaaagcattcacagagagggggcagatcacatattgaacagtggtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaatgcaacactctgtttctgaaaagtgtgggtgctttccaagctgtcggaccaaagtattactgaaagttattccatttgaggatttgcacatttctttccaagttgtgatttttaaagaggggataaaaaaccaatgacctcattcttttgcatttgtatcaactttgatttccagaactttaactgttttgagtttatgacgtgtccagtctcaagtcagtatagcaatgagtaatcattgtagaattgcctattaaggggcaggcatcgttcctgatgctggaataaaatagcaaatgaagctggcctggcccatttctacacagaacctacatactagctaggaagcagaaggccaccttcagtcctgctgaatttagaaatacagtatatgaattggtatgaaaagacgttcacaatgtattggtatgttaagagatgatcagtgacaaaagctgtgtatcaaatgtatagatagattgataatctacacaccaagatgctaaaagtgattagtttgaatgatttctcttcttcacctctctgcagtttatagttttttgttaagtacatgtcttgtttacataataaaaatgacttaaagaaacgtaaataataacgaatatgcctcatacaggacaaactaagcaacaagtctggtggtatcagaatttgtacagaaaaacctctaaggtacccagcaatatgtcagaaattaccagactcgtgacttcaagtgcctttaactcttagtcatgagaaagtactattacctagtgataccatttgcaaaagaacacacaaacagatgtttctgttgtttagctgagtctctctttcaaacatccatggacaattgaaatcttccaagtatccgttggtttacacaacttgctccctattattaacaacaagagtaaaatagaatttaaattttgttttgtgtttttccacatataaaatctaaaatagttcgttactaaaagcaatcctgcaatcccacagatgtcagaatagtaatttaagaaatatgtacctatctgtatctgtatggaaattaaggccaagataagtaataacaaagtagcattgatttgttaaatgtctttgctagtgactgctgtctggaactactgaaaactgcagtattaacctctaaattgtatccctgagaccctcttcacactcacacccattcactggaattgaggatataagacagtcctgttagttgatgtaacttctcctaagggggaccagtgtagcttgaacatctacttaatcagtctggtacctcatccccatcaggacagtatgcccctctgattaaaacagactattgtcatcctgagatggagggaaattgattctaattcatggacaaggaaagagtaaaatttaaaaacataatctattcaagatcctgactttaaaagcaatggcttacctaagattacgcaaataatttatgataaaggtgggctgaaaatgttgggcttctatagtcaagtcaggacctcttgctgtgatattgctaactcctcagcctgggtatttacatcgggacaccagaaagacacatgttttcctgttggttacatattcatggtcagtggagttaaggacaattaaccaaggaactctaatgttcattttcttcaaccacttcatcctttcttgagtattgctctaccttttttgttgtgacttgcaaaaataaccaacacaaagaggctcagacaaaacacattcttcaagggagaactcactggtgtacaaaacagaaaagtccaagagatggatctcaggtacagccccaaccatattcagaaaatatactcagaaatctctgtgcttgtgtgtgtgtgcacgtgcttctgtgcttgtgtgtgtgtctttatgtttctcagctctgctttctttgattcagtcacagaaaagcccttcttggcacctacagatctccacttacattcttctagctgagccctttgagctgaaagagagcacctctgccactaaagcttggatgtttaagcaaaagtctcaggactgcctgtcattgcttcagcttaaagtataggcccatccattaaccagtcacattggcttggcagtagtctatggagattggccaggtctgggtcacatggcaacctatggaggccaatccttaatctttttctctggaaccatatggtctgattttttttttttttttttggcttcacctattttcttttttcttagttttttattttcataggtttcggggaacgggtggtgtttggttacatgaataagttcttcagtggtgatttgtgagattttggtacacccatcactcaagcagtatacactgcacccaatttgtagtcttttatcccttactgcacttccaccctttcccctgagtccacaaagtccattgtgtcattcttatgcctttgcttcctcatagcttagctcccacttacgagtgagaacatacaacgtttggttttgcattcctgagttagtctgcaatctcatccaggttgctgcgaatgccattgacccattcctttttatggctgagtcatattccatcatatctatctgtctatctctctatatatatctatctatatatggagatatataggtagatatatagattcagtcacagagatatatatctatatatctatgtagatgtatatagagatagatagatagagatatcacaggttctttatccactcatttgattgatgggcatttgcgttggaggaaccatctgatctgagaatggaggaggtattgtttcactcaggagaggtatacgtagacaatagatgctaaggaaggaaagcaattgttctttgtccagtctttgtctgtgctaatgacaactctatgaaactactcagtccaggaggatttcttacagcacaactctctggtgttcatgggactgacagttctggaatatttaaaactattcagtacccccacctcctgtcttgaattcctccttgtcctttgaaactcctttaccgtgaatctatagcagcatcatgacctgtgaagacacagtgcactttgagttcatttttcctgtgggctcttttttgttttcgtgtgtcaggttcataatgactgtgtgtgcatgaatgtgtgcatgagcatgtgtgtaaacacatacgtgagtttccatctctagaaattactgtcattcatcctggtcagagaatgtacagctttgtttaattaaatggtgaagctagttgagaattggcaaatggagtcagattgaaaaatattttacagctctttattcttcattttgtatttcttgtgttaaacagagaaagaaaaaaacacccttgggattgtaagtgatgaacttaagtctttgggattcctttataattcagtaggtcattaattctgcactacttgttgccttttggcttaaacatttgtgttttctatgtgcttagggacttctttttaatcttttagatatctgtctatctcaaggtcctggcataataataataattttatttcttgtgtaatgatttgatttaattcaaacattgtggaaatcctacgatgtgtgagctccatgctaggtgcttgagatatgaattcatgacacataatccctgccaccaagaagcacaaaatttttaaggagaattagagagtgacgtgaccagatgccctaaaaggtgtctgctggacagcattaaacagatacacaagcaaacaaaatagtatattaattaattcatgaaacaagtatttatcatgcaccagacactattcttggcagtgggcatgcaacaaggaggacatggacacgtccctaatcctacgaagcttgcattcccatgtaagccacacagttaaaacacacacacacacacacacacactaaatgaacaaatgcataattgcagcctgtggtaagtgctatgatgtcaggaaatacttctataaggaactgatatttaagcctgtttcgaaagttgggaggaccaactatgcaaagagtcagaatgcaagaacattgtatccagggagaacagaaagtgcaaagccatcgaggctgagagagattgctgggttcaaagactgagtggctggtgggtattaaacctgtgggagatcagcacactgtgagctggagagcaatgtggaaacctttattcagggatgtaaatgccttctggggcagacagacagtagatattctcatctaatgcagcatattctggggtattattagctcaaactggaagggggccactctagggtggaggctggacctcaccttaggattcctcgattcttgtacaacactcctctccttactcaggaggctttattttcttaaacacagctttattgaggaaggattaactgtacatatgtaaagtgtacattttgataacttgacttctgtgcatacctgacaaacttgactgtaatcaaggtagtgaacatctgtcaccccagaagcttcttcctacgtcgctgacatccttctttccgctcctccccttccaccctccccaaaacaaccaccaatccactttctatttctacacactagtttgccttttctagaattttatataaatggaatcatagaggaggtggagttactttttatagcttttaagcccacacagaataaaagtattctaatcttttttccatatgtctttttgtgtctgaaaaggatcttaaacatctctaacaataacctccttgttttctctacccgtggtctaaaacctgtgtttgcttgatgctaaacggtggagggatttttctgacttgaaaaaggcagagtttacctctccttttcttatctccattattattttgaaaaatgcaattgacctaggaaagaaaaagggggatgacagtgacataagattgggggggagagggtagagaggtgaaaggatgaatcaagcaaagatgctgcttcatcgttctgatcccagaaattagatgtgtggatgaccaattttcagctaattagcataaaacaaaatacatttcaggaaaattgtgctcgacacaatttaatctctgatggttcagaacagtctctgggtcatcatgagcatcagctctggaatcagaagcactggggagaaggattaatggggaactggtattcagggagctcaacatatatgctcacaatctccccattaacaaacaagaacttctttctattttatttcagtacagcttgtcctttgtttgcttcctgaataatttgaaaacatgtacaagttgaagtgtaatgcaatataagactttcagatattaaacattacatagtttaggtatacaattgattcatccattcattgatctggtaaacatttattaaacatgtactgtctccaggatatgtttctaggtactgagtatatggtggtgcagaaggtgattctgtatgtgcctgtaattgtttgtgtttgcgtatggttcagtgggatttgttagagatatgattaattgcttgtaaaataggaaagtctaccctgagcataggagtttaaagcaatgcaacaattttgcaacatccaccacagttaaaagtgtccatactctttgatcctctgatagcactagtggaaatttatcttggagatacactcacccctgtgctcaaagatgcatgtattacgaggctcatgaaggcttgtttgttgtacctaaatccccgtcaaggatggactagtgaaacgagtcatgatatatatttatggttgaatactatgcatctgtgaaaagaaggaggttggtttgtctgtactgacattcaacaaactcagacatatggtcaaggaggagaaaagcatgaagcataacgttatgtgtggtaggtttgcatttgtcaatgggatggaaaagagggcagtatacgtgcagcataggaaaatacaagacactgctaacttctgaaaatttattgatgagcaggggagtgaggatggaaaaagagccacctctttgaattactttaaatatttccaaggtgaatgtactggattttcagttttggaaagctaatcttaaaagtggaaaaatagataaaacaagtataaaggataccagtagattttctaatgttaaccttgggacctcatatattattggatgcaaacgtctacaaaggttgctattctgtcccccttctcccttgaccatgccgtgaaacaaagagaaaatgaacaaatccctgcaaccaaaccctctcaccagatttgactactgccaatgagattattgagttaccaactgcctctcagaaccctaaggcaatttggagcccagaaggaaagtgaggcccccaggtggatgtatggaaggaaggtggtgcacctttgggcccttgtgatccaggtgagtgacagagtgactcacctaaaaagagagggaggtctctgcagttggaagctgcaaatgatgatggtagaattttgcacaacccagggatcacaagcccagttttaggggaaagggctctaagagtagagacatccatataggcgcagatagtcctcctttatttaaatacaccagcagctgcaaggagtaaagggtcttgaggtggaaaagaagaggggtcattccagatccaaaaaatcgagatgactcctttgagcaatttcattcactcgtttgctgaacaaacctgaattgacaccttcttggcacagccttgcactacgtgatgaggtgaggtgctaggaccaggtcactagcattcactgaacttttcatttcatgcaagggaaagagccccctatcaggtaatctcacagacaaatatacaattaaaaactgtgataggggttattaaggacactgcagagtaaaacaaacaagcctgattatcttacagggaggaggagttataattcacctgtttatttagaaacctgctaatactaatcactaagaatctctgtgtggtggctcaggcatgtattcccagcacattgggaggctttggaaggaggattgtttgaggccaggagtgtgagaccagcctgggcaacatagcgagaccccccgtgtctcaaaaaaaaaaaaaaaaagaaaaaatagccaggtgtggcaccaccctcgtgtagtcccagcttctcggggaggctgaggcagaaggatccccggaacctaggagtttcaggctgtggtgaactatgatcatgccactgcactccagcttgggtgacagagcaagatcctgactcttaaaaaaaagatcgttcccactttacagttgactacattgaggggttgaaagatgaatttgcttgcaaaacacagcaaatatgagtggagacaagacttcagccaattaacacagggctccggcttaaggagagcctgagcacagtagttgcatagttggttattttaacaataaaatctaagaacttcgagtacacagtggctaatagctaggagggatctctgggcacgaagattagtgtagttgctctggtgacatttggcatattaacatgagacatgaagaaacctaaaccatattcattcaccatagttaaatgaggcaggagtcaacaaaatacagcctggcattaatagcctaaaaacaagatttttgagtttttcttaaaattgtgcacgtaatattacaaagtggtcatgtcacaggagaaaattttagtgactaaaggctggaatgtctgtctatatttattctagtatataactggtaaagaatatgtgttccctcccatcccagggtcagctgtgatatagaattaagatttttaactttgggtagtaaaaggacaccagggcatccatgctctccctgaaattgtgtatcgtacagtatttctggaaagaagtcttcatttgtttgttgtttttttctcctagaagggcatggcacacacacacataaaggttaagaaaaaatactgtttttgaaaagccaaataactgtggttcactatgtcgagacatgtggccaatctcattttcctacagatgttgttggacataaattgatgatttcaagaagcaaaaagaatattctgcaatgctcagtattaaggagttcagtgtgatcagatgggcctttgtcaaactgaagtattttaattaacttacaccgtaaaagtgaaagtgtaaagctttgcttttcttcctagctaatcaatgaagattaatattctatgggaacccgactttgcagacggagctgagcggcactgttttccctaccattttttcctcatagtaaataaatcatttttattatactgtatgaatttacttagctcttttaatagcctttgtaagaataatgcttcctttgattatattacatttttaaatgagtgcagtgtggaatacagttctgctgttgggggaagggtggtgagaaaaggaaagagatactgattatatcagttttatcagcttatcctgtgtgttttaaaccagataaagcagtgtctgagtatcctgggagtcttaggagtaaattactaagtatttgctaggattgaaatggctcatacctgtgccttgtataaaactacttctggggaagatgaggttagtctgaaaggacctggtctttataaaattattctgattgttattttgtacttttttttttttatcttcaaggttctggccaatctatttgattttttttcccccaaaggagagaagtaaactttataattccagggctaacatccacttgtataaattgatcagttgaattgaaaagctgctgactggctgatttagcatgttcttcaagtggtctcattcacaattgataagctgacttgtcaccctgaattattggaggcttaacccttgaaggacagatacagtttggcctatacagattgtacttttcatgagacaggaaaagggaggaagggaggtaagtgtgtgtgtgagagagataaattaatttcattagaaacaaaaatatcctgtgatcttatgcgttagaccaagtgttgaaatattaaagttcctgatgagaaaattcagaatcatacaaactttgtttttctatgtcatccatcttgtacatagtcagcaaaccaattcatttttttgagatggggtctgtcttccaggctggagtgcagtggtgcaatctcggctcactgcaacctccaccttttgggttcaagtgatcctccagcctcagactccaaagtatctgggactacaggcacatgccaccacacctggctaattttttgtatttttttttttttttgtagagacgtggtttcgccatgttggccaggctgaactcctggcctcaagttgtccgcccgcctcagcctcccaaagatttgggattacaggcatgagccaccgtgcccagcctaacaaacattcttttaacatatattgtccatcaagtcagaacctttaatagctcctattcagaacctataatagctccacactgtttatggaaaataaataatggctgaggctgaaaatttaaggttatcttaaatgcagcctcaatatgtaaactctgtgtgtgtgtgtgggtgtgggtgtgtctctctgtctgtctgtccgcaaatgggtcaaagtgaaaagctcttgtgaccttgattcacaagactcaggtttgagcttcatttctgcagtttgttagttgtgtgcttactcatctgttctaggcctctgttttatgatttgggtaacaggaatattagtaatgacagcaataatggggatgactgggctataatgctacttacctaatttaactgatgttttctggaaagaatgaaatcagaaagcatatctgcaagtgctggcaccctctgtaaggcgctgccgaattggttggttgttcttacatgaattcaggggtgagtcagacccatcgaactggagtcagagaaagccttgcaacctggacagaatggaaaattaatttttcctattgcttcaggcacatgttgaaccacggtcaattcaagtttgagatctctgcagatatatacgtttttaatttgtcaactaaataaatacacagatacataaatacattgagctttctgaggagacctggagtctgcatattctgtggagttgatttgaatggagacccaagagtgtacctctgagtcattttgggtaagagtaatgctctatagttttttatctttttttggactttgaggacttatacaatataatgaaaaacactgtttttaagtctttccgcagtaaagattcttacaaagcaaaagataaaaagtttcccttctttctcatctacttgccatgttctcctcctgttgacaatatcctcccacttccctttcgatcttgttatgtatttggttgaatcagattccattgctgatatttgactacttagatgtattgtaacaggaatatattatgcaattatgcacccgcaccattggagccacatgatgaatgtatgcaaattattatgttagcatagagtgcaatactacacagtgtcttctgactcaatatccttccacccaagaaacacatcttggagattgttgcatgtcaacatgtggagatctattttgttctttgcaaggctgcataatgtcctatgttatagatgtgttctcttttttttgtatatttgctcccttattgatgatgggcattaaagttccctcccgtgctgatggacattaaagtggcctcccactaccaagttttcacagttactcacaatggcactctcgggtcatgcatctcagtgtgtgcatgggtgatttctttttataggatatattcctagaagtagaatacttgagctttaaaaaaaatcacttgtgccttttgcatcgtgagtgcttagtgaatttataattatttgatcaataatgaatgtgcaatgaattttatgagcaaagaactgtcacctcatatttggcaaaattttctctcacctcagacttgggctattttaagaaaaaagaaacctgaaacctcttgagtttttaactttcagttgtacttaagagatcagagttggtgttcagaggcagatcagtctttacgtggaggtgctaaggttgcaaattacaaaataattaggaaagtgattgtgtgtgcacatgagtgtacttgtgtacacattttggagattttatattcaaactgcaatgaaaaaaatatgaatacctgggtagctgccattttgctatggaggtccaaggtcacatatttaatagttctaaatttatacccctgggaaggaagtatatgctcactgtaccctttaataaaggcacagaaatgtaccgtgcagtctgcatgaaagcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttcgattaagtttccaacgtgtagattcttgttagcacttagtggtgcaacttttataaagaaacctggtatttttttaattaactgatgaaaatggatgtaagtaaggggtggacattcccatgtcaatgaatcttgatggtggcctccggtcactcatggaaaaatgtatttttgattacttgtgtgccagcaacgttgctaggctttggatgcatggaagcgaataagaaatatgaaagtcctacctacatagagcttatattctaatggaaaacagaaactaattcttttgccttagttacctattgctatgtaattaccacctcatagttgctgtggactgagagtccgaaagcatgtttgctgagtagttttggcaggtgttggcaggagctaaaatagtgtcaaggctctctttgagggggaccttcactgagctctctcacctggctgttagcaggctggaagtttgctgcccacagatttacctctggaaaggtgtcttgggacaaagtacatagctcctccagaataagcaattcaagagagaatgaaagaggggacacccaagacagagaatccagtcgcttttattgctgatttaggaggtgacattccatttctcatgctgcattcttttcatccctataattaattaatctagcctgccccgaaggggagggagttacacatgaacagggatcactggggaccatgttacaggctttataccacatttattaaatgcctacgctggggagcactgagaaaagcataaaatagcagtgatgcgtataataggcaatgacacttattgggggcttcatattgtatcagctgtgtaccaagggtaaggataatgaaagctcacatatatggagtaaccattgtgccaggcactgtactaagtggccatgtgccctttctcatttggttttcataacagccctttctcagtgggtaccgatcagtacccattttacagataaggaaactgaggcacagacaacaatggcttctgaaattctcttctccgtgtcatgcactgcatttttctcccgttcaccagttgcatcttaggtctcagttcattttcaccaccttcctgaatatatagagagaaagcccatgcagtaaaccaatcaaatcctggctatccgagctgctctatctgcctctgaaagcctaggagtaaaggaaaattgtcctcatgagcagttcatgaggtgtcattcaaagcacttttgaggcaaagtattatgtttcacagccatggttcccagtagggacagcaatattgcagtgaaatgcaccaacatctctgcccatcccaaactctcctctcaaaccagtttattgaaatgaggcctcacttcacaagtaaataagtagtcaagctctggatttgtctctgctccagcttactgtatatttccactaaatgagtccattaaagcttaaactaaaccttttggaaaagaaaaacaaagcccacagcagctgtccagggctgcgggagttagaaaatgcaattcatgtgacttggtggaatgccagtgaagctaccattagattattctgtttactgttaaggtacgtggagacagacaggctctggagatgtccgacctgcatttggatgacaggtattgaccacctccttgatgccaggcatggtgctatgcagaggcatataacagcacacacaggacacagaccatcccctcaagggttttgcagtctcgtgggagtcatcaacacaagatttaaataatgtgtcatgtgtgctagggagaggaagtttggggttctttgggaggatataaccttgagaagaatcaggtagggaaagtccatagagaagggtttgtttcctctgagatacgtaggccaagaaagagttagggaagtgaagacaagaggggacagttttgtcaaacatcagctataaatactcaaaagcagctaaaataatgatatatctgcaaaactggaagcagttcagtagggttgaagaaaagatagtaaagtgagggctggaatgggagggcagagaggtggcaggttggaagactagctaagcattttgggctttgtaacaagggcattgacacatgttaaactcgggaaaaactgatcgtttcattgtacgaacagcctagcttataaagttatttaattagaaaattttcagaatacttttgattcggtggtaatgtgtcaacaaccctaaaatgttatgtgtttttctgtaaagtatgtggatgtgaagggaagcaacatggggcatgattattaagagtacagcttctggaatcagagatcatgtaagttggaattctagcttatccaattacttaatgtgtgagtttaggaaaatatctattaacttaccaccaattacttaatgtgtgagtttaggaaaatctattaacttaccacaatctatagtacctcatctgaaaaatgggaataattaattaatactgagctcatagagcttttggaagaatcaggttaggtttttacgctgcatagcacattaccacctgcagaagcttaacacaacactcttttgttatctaacagtttctgtgtatcagaaatttgagcatggcttagctgggttctctgcttaaaatctaatagactgcagtcagggtatcagccaggactgggttctcattagagactcatctcgaacaggatctgctttcaagctccctcaggttgctggcaggattcattttgttgtagctgcaggattcgtggctgcttgcttctgcacatccagaaatgggtggagagagagacagagacagagagggagagagatccagcaagagagttgctataatcttatgcaatcacttaggttgatttcctctctttgcaattgtgaattgtgctgcattaagcatgcacatgcaggtgtgtttttttatacagtgacttgtattcctttgggtagataaccagtagtgggattaactggatcaaatggtagatctatttttagctctttgagaaatctgcatactgttgcatactgtttgccatagaggttgtgctaatttacattcccaccagcagcatataagagtccccatttcaccacatccatgctaacatctattgttgtttcactttttaacagtggtcattctggctgggtaaggtggtagctcattatggttttaatttgcatttccctgatgattagtgataagcatttttttcatgtttcttggccatttgttggctattctcatcttctgagaaatgcctgttcaagtcagagactcagaaggagggaggcaaggaggagggtaaaggatggaaaattacctatcgggtacaaggtatgcaattcagttgacaggtacactcaaagccaagccttccccactatacaattcatccatgtaagcaaaagccacctgtgcccccaaagctactgaaattaaaataaaccttatataatcacatacatgtaatcacacttatcttatcacctctgtcatattccattggttagaaacaagttgtgggtcctgctcacattcaaggagggattagtaaaggcgtgaatgttaggatgtggggatcatggtgagaagaatcctcaaggatgcacaccacaagaatttggtaaaattgtacacataaggacagaatagaagcatttagccttgtgaagaattaccagggcaccgaaagagagaatggaagcatataccaaatagagcacatagagaacttgctcagatctcttaactgttgttgttctggttatgatatgatttttaggaacatgtggcagagtgtttctgtgagtttggtagcaaatacatattggatgtacttgcttagtcagttctgtgtgccagaggacactcatggggagagatcaaggttactttttgcaggtggggcattttgtaactgaataaaacccagtcagtaaaagtaagcaacatgcggaatctaggcaagtgttgcaatgtatgtgtgctcttgatctgaggaagaccatgcatttgactcagactagaaacctacaccacagaaatcccacccacaagcaatgctctattactgtaggtacaaggcagtaatttttttgtgtccattcacatatgcatgtgtgtttgtgtgtacataattgaccaactatcctcaggtttccctatggtgaatgatttattgagtcatcagacttgtggaacacctactctgtggtggccatgatgccagcctctagagataaaaagtacaataaacgagctatcttaaggaaactcaaattactttggcagacagaactagtaaactgaccactgacaattcaaaaatccatggggggagttccatttcgagttagatgggatatatttagggcaattcccatcctgtttcacttagatatgtttcactacatatcaaagtaaacttcagaggaaaaacaacaacaaaaaaccacccagacatacaggaggacattatataaggataagagggccaagtcaccaaaaagacaaaacaatcttaaacaatcatgattatttatgcacaaactatgggacttttaaaataaagccaaaactgatagaactgaaaagagaaatggagagtctacaaacataagtgaagtctgtctcactatttgataaaattaatattgagaaaattaacgaggctgtagaagtactgaacaacaccatcagccaacaaaacatagttaaaatgtgtaatcaacaccatccaacagcagcaggatgtccgttctgttcaagtccacatgagatatttaccaagataaaccatattctgtattataaaaaacttaacaaatttaaaataattgaaatcatatagttgctttcctctgacaaaattgagttaagctggaaatcagtaacataaaataaactggaaaaaatctaaaagcacttggaaattaaaccgcaaagtctaaatcacccatagttcaaagaggaagtctcaaggggaattatagaacttaaatgaaaatacattttacaaaatatatggtgggaagcgaaagcagtgcttagagggaaatacataatgctaagtgcttctattagagaataagaacgttctcaaatcaacaatgtaagtgcatatcataagagactattaaaaaaagcaaatcaaaaactaatacatgcaaagagaaagaagggaatagtaaatgtaagattaaaaaaatgaatttgaaaatcaaaaagcaatcaaacctaaatctggctctttcaaagcatagaagtgatgaatctattctagcaagactgacaaaaagcagagatgacaaaaattacaaacatcacataaattaaaaagattataaggaaataatcaaataatctatgcacatgtagtcaacaacttacatgaaatagactaattccttgacaaccattaccaaaacttattcaaaacaaacaggataagctaaatggttcaatagacttatttaaaatatcctgccaaaataaaaattttcagacacaaatggtttcattggctattccaccaaacatttaatgttgggaaaaaaaaaaaaaaactatacacagtctcttacagaaaatagaagtggaagatatacttctcaactcaatttatgagtctaacattaatctgatacgaaaaccaggctatatgtaatattttatatatgtatatatacacacacacacacacacacacacacacatacgtaaacatatatcatggaatacatataatacagaaaaataataacatagcatgaccacatagtattagtcccaggagtccaaggctggtttcatattgaaaaaaatcaatgttatgtaccatattaacacaataaagaagaaaactaacacatgaccctgtaaaatagtcctgaacagtattggaaaacaaaagctaatctacattgatgataaaaactctcaactaactagaaatagaaggcaccttctgcaacctggtagaggatgtcaacaaacaaccccacagctaatatcatacttattggtgaaaaagtgactgctatctccattagagcaggaacaagggaggagctccactctcaccaaacttatgccacatagtactggaaatcttactcactacaataaggaagaaaaagaattatagagcatatcggttggaaattaatatataagggcatctttaatcacagataatagaattgtctatttataaaatcccaaggaactctaaaacctcttaggtgaaaacataaatatcaatcatatatctatatactaggaaagaacatttggaagtcaaaacttaaaaacaaaccatttacaatagctccaaaaaatgcaatacttagctataaatataacaaacatataagagatctttatgctgaaaactataaagtatttgtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggtaattaaacttgcccaaagttagatttttagcaggattcaaaccaggaaagtctggctccagagtacaagttcttcctcattgcaatgttctttatatagtttttattgattcggcttggatagtaaccccacaattgaaccaatcattttggccaggaaaacaaagtgtttcatcggtttggttagatttgggtcctgtcttcatttctaagatgaggtacaggagtcagccctacctaaaccatgggtactggaagtggcataggaacagtagctcaaaggaaagttattttcagaagaagtaatggatagagatcaggtgacaaaataatatcccccactgatagggatatggtaggggcaattgggtaaatttcaaggataagaccttgccatgatactcttggattacaatggagagacacatttgccctatctcctggggaaaaaaattgaggaattacagttggctttaagtgtatgcatctgattgttgactagatcatgaggaggataatgtggacattaggaagaggggccttgcagaaaggggcagaaatagcaaatttcaagtgcctgggagcccccaaatcgggttgtgtgtgctatttttaaagtaccaggagacacgacaactcctagctgcaaagagacatttatcacactgaaaaaaaaaatgagtgaatggttagacagatagatggatgatggatgggtgggtgggtgggtgcatggatagatggtggatgaaaaaataagcaatgaatgaccctctagatgataagtggaaccctgctttgttttccatttcctgcttcaaatctcatttgccagcaataccaaataggatatatactcctctacttccatctatacctggcctctaatcttcttcatttttgaagattttttttttttttttttgagacagagcctagctctgtcgcccaggctggggtgcaatggcgagatcttggcccactgcaacctctgcctcctgggttcaagcaattctcctgcctcagccttccaagtagttggaattaacaggcacgtgccaccatgcccagctaatttttgtatttttggtagaggtggagtttcgccatatttggccaggctggtcttgaactcctgacctcaggtgatctacccacatcagcttcccaaagtgctgagattgtaggcatgaagccaccacgccaggcctgaagactgattatttttaagccagctgaatgggttaagtgtttgtccattgtgctctggaaattctctgagcgtattcacattattacacttaacacttttgtgaaccacatccttttaggcaaaagtgatcatctctgtctcactcattgcagtactctaatgcctaacacagagcctgacccagagagagtgcactgcaagtatattctgaatgatggagtgaaacagtgagtcagtgtgcaaataatgtgtgttgataagcatatgtagggtctgcagtggtgatgtaggttttatagccaatgacatctccagtgcctttttacttgataaatataagactataattttcttaaaagcataaataataggaagtgttctcgaagcccattcctggccaaattctttgcctttaatatcgtgcttaaattttgtcaacgcatttcttttaaaaaatggaggaaaactgagtggggaacaagaacactttctcatctcattcataatctatcaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactccccatgcagaacatccaacataatcacttcaacaaccagcttttggaaaagcaaaagcttcttacagacagaattgtctttctgccatgcttggcttcatccctccactaactctattccttttccttcttgagttcagagacaaagagggtcctatatacctacctgtttgagtgatggaagagaggaggaaaatcctaactaaatagccccagatagtttgcaaccaggtttttaaaatgcttaacatggttcctggcatattatctgtgctggatcaagggtaagggtaacttctactactactacttttatcagcaatggtgaggaaaggatcagagacctgagtccaccctcgacagtttcagtttttggtaaagaggcaagggagaggagaatgtttcaagaatgttgggttggtgaataaaaccaaaggccatgaagaggttgaagactgagaaatacattgattggattcttttttttttaagttcatcggtgagctttcagggggcagttttagttgctgtggacagaagacaagcattcatgtcttaaggaatgaggaattgaggaggaagctaagacccttaggatggggtgagcttgtaaaatgttggctgtggaggaggaagaaggtaaagacataagcctggaaggaagaactgacatgagttttagttgctgacttgatatccaagtcaagactgcagtggatcccaggacacctggaaaaagatagctgtctgggcattaggggattaggaatattagccaaagaatggtaggctctgtctaggtatttatggactgttctctctttctctctgcatgaaactaattcattctcattctcttattctctccttctctccctctctctctctctctctctctctctctctctctctccctccttctccctcccaatttgtccattttctgaatggacaaataaattttgtccatttttttttaaatggcttttttttttttttttttttttagttttttaaaggtcaccttctcttggttatttttctgaccacacaaagtttcttttccccactctgagtctgtatgataggattttcttcattttctgtgccacttcgctcagtttgcacttatgttttcatggctatattgtctaacttcccaaatatgtagttttgtaaggagagaaatgatttcttcaatttattgttggatacccaggacctagcatatagtatgagtttaataaatacatcttttaagtgcataaatgaatgcattgatgaatttgggggcatctttctatttttttaaaggaatgaataaaagaatgtggcatatttctaggcagagctcatcaatatctgaaccaacaattcctgtgtgaaacgctgaaagcagaacctctcagagtgatatcctgtgcaataattattggaactgggagtgagagacggagacttgaatgaggaaatatttatggggaaggtagcgttaaactttccaggatgtttccttggtatgctcataatggatttcaaagatccacacctcttggcggactccaggagcaggatttcatgaagctcttttgtgaaatgcttccattaggcgttggcatctttcccaaagggattcaagcatggtttctaagtgtctcagagcctaacgtggaattgggagagagaaggagggagtgaagaggaaccctcgttggaagtaataatgaagcctcctccagctttgcagagctctgccaggaagccaccctcagcaaaccagggaacctcctgacgatgagctggggtggtttctgaaccatgagtcatcttgtgcaaagtggctctggctttatcaggatgatgtgtctagacttgcagtcagctggggagcaagtaggaggatcctggggaggaggccgggaaataatgggtgagtgttagtgctggatccagatcgcttcctgcccttcaaggagttaagttcagggcatctattcacacccaatatttattcattattcacccacggaataccagacacagtgcttggttctgggaatctaatgctgaccaagacagataggaccccttctctgatggaccttaaaatacagcttgggcggcagctagaagaccttatcgcatgattgttaatccaagttctcaggtgtgctctaaggggaaaatgcgcagcagtcaatgagagcataaagcacggaaatggagttttgctagagtgcatcaaggatcattgttattttatttttatttttattttggaaggtggggccatttatggctccctgtaccagatgaaagattgcatgttcattaacatattaatgccatttgtagtttggatgagttaaactcatctaactttagtgtttacaagggatgagctactatagtcttttggatcccttcttctcctttacctcatcatcctatccaccagtaagttctaatccatctttcctactctgtccctgctgtcaccagcctggtcacggtccatcatattgacgaccgcaccagccttctgactggacaccatgctactgctcttgtttcttctcacctattctctgcacagcagccatagtgaccttggaaattcataaatctgtcatgtcagtccccttcccccttaagatgtttcagcgggatcctatttcttattttccttctccttcttctccatcttctccttcttcttcctccttcttcttccttcttccttctttcttctttttatctgagacagggtctcactctgttgcccaggctggagtgcagtggtgtgatcatagctcagtgcagcatcaacctcccaggctaaagggagcctcacacctcagcctcccaagtagctgggactgcgagcacacaccaccacacctgaccaatttctgtatgttttgtaaagatggggtttcatcatgttgtccaggctggccttgatctgctgagctcaagcaatcttcccacctcagccttccaaagtggcgggattatggacatgagccaccacacctagccaagtcccatttcacttaggaaaaaaatcagactggttaccatgcccgtgaaatgaggtccatgtcctgagcttcttgttgatgtcatttcgtgtcactcttccatcagcccctgtaccgcaggcgactctggcttcctgagagtccctggaacaatttaagattgtgtcctacccctgagtgtttgtatgggctcttccctatactgttctccgcatggccggctctttcttagccattgggctgtgcctcaatattattttctcactgggattttcccttatctactcatcttctggactgtcaatcagagcattttgattgataacagtttaatcagtaattatcttgtttgtatatacatgtctttaatatgtgtctccctctctaaggtcactgcattccagtgagaaccacctctactgttttgtatatgacattcccaatgccttacaccgttctgaacacagtgttgcttaaaccagtattgaatgaatgaaagatagaaagaaaatggtcagccctgagtaattttctcttatttttcttctcttttccttaatatcatctgcagacacatctgcagagtattttttttttttctgtgagaatccatttctacctatgatatagctggtttctgacccttgagatatgactccaaaattgggactgggtggttgagagtgctttaggagaggtaaaatttgtcattaatactattgtttatgtgtgcagtgtccttcatattttttcctttcatatagcatttgacatttgcaaaatgttttccatttatttttatgttggggaaagcaaaaagccgtacgtgttttttggtgtaagtgagcataaaagcaaggcatctgattcagggtgatattttttgtcattttctttgtgttttgatcagggaaaattagagagagagagaggaagagagaggagaaatgacaatgcgtccaactgttttccagccctcctccaccgcattcccgacccagctctcagggagaggactgagccactgtagaaaagtgggaacattaaacgacccaagaaaatgtgaaatggtgtggggtgtgagatttctttattagtcaatttaaaataaaatgtgcctcagtaatttagaatctgtctggagtcaagcagaaaattagccatattcccatatcctacccccgcccctggaggcagcagaagcaccaataaaaataaaaataacaataccttgtatttatggggtagctttctcccagacctccttctcactcaccctttttatcttttctgtgtccttgaaggggagtgagtgagtctctgaaacctgggagttcagctctctgcagatacgatcctcagcattaaaacttctccaaagtccttcatttgatcatacattcatccatgggtttattggttcatttatactatttagcagtgcttactgagtatctacactgtgcttactgtgtatactgcttatacacagtatatcttacaggtagtacaagatcctagcaggtactataagatcctagaaggtaagagctactactatatagtccctaggagctattactgtaatgtctattcacagacaatggaataatcttgttagttttttttctgaaaacaatcataactctctttaaaccatggtgttgtctttggaacattcatagtttggttcctgtgtagttttcaaggtccgtaaaggctgagtttcgggttgatgtgtctgtaggctttttcccttgggggaaaacgtcttcatagaatttgctcctctaggtaatagatcatgaatatctctctagtttgcaaaaatgattgtttaagaaaggacatggatagacggatagactccatttctcctcttaaagatttcctcattttgaggggtcttggaattatttgagtgtttaatgaaagcaaagaacttcctccccagaggaattgatatatgcacaaagataacaccattttgtaccgtcactttagggttcacactttctggtacccatccttggacactatccatggccacccaggttaaaacttcttcttttctctttctttttctttcttctttttttttttttttttttttgagtcagggcccctctgttgttctggctggagtgcagtggtggcacacacacagcagctcactgcagccttaacgtcccaggctcaagcgatgttcctgcctcagccgcaaaaagagctggaattacatgcatgagctactgcgcctgaatctagacctatttagaaagttcaagtctgaacatttagtgatgccatagagagccctcccttcctgccagcattcattaaatgatggttttcactctgcagagcagcttccctccgctttccccagatagtctccctcccacctacatatgagaaaataaaatgttttcctgcatcactatgaaaaagagccctaaatcaatagcaaatcaagctatggaataaaagagtctttatggcccgagaaggtgattgctgaaggttgccatttagcagtattgggtttgtgtctccctggggtctccagcagcccagtgtctctgatgtgaggcacctttgcctacatgaaagtcagcccctctccccctcccccagtggagtgcagggagataagaattctgaaacaggtcagctgacgttgttttttaaaaaggttttgttctgggcaaatcctagccggatgtgactggtctgctcttttggtaccaatcctagcttgacagtgatccctttccagacataagcacctacaagtctcaggatggttttgctgcaagcagggggtaccatcccaatcatttctttaccccctacccttttttgtttcgttttgttttgttttgttttttgtttttgagatggagtcttgctctgttgcccaggctggagtgcagtggcgcagtctcagttcactgcagcctcaacttcccgggtacaagagattctcctgccttagcctcccgattagctgggattgcaggcatgcaccaccacatctggttcatttttttgtattttaaatacagacggggtttcaccatgttggccagtctggtcttgaactcctgacttgaagtgatccacctccctcggcctcccaaagtgctgagatgagaggcgtgagccatcacacctgggcttcttccccttttgccatgtgatttttttttcttgcacttaaagcaagtgcagaacctcatatgatgatctatatgcacttactgtgttttacccctctcggttatgttagtgggggtatttaggaaccatgctcattttctgggtgtttaatagctgaattctgtttcatttagatactgataagggtcttgaaatttaaaaaatgtatctttaagcttgacatctcccagtggtatggccctgtattagggagatataaaaatcatgtatgagtctccctatacctctctctgtttgtgttcccgcacacacactacttctccatggctcctccatatggccagtcctcttccttcatatacagcctagttctctgaggttcccatcccctcaagtccatgaccctctggcggagtagccgtagtggacaggtgcaccctccttcactaccttcctttctctgcaactagtcaccccatctgtgtccacagtttgatgactggctaggggctaagagtgctgtgattaaaactgctaacttcccacttcttttgactgttccaaatgggggcaagaatgaattttaaaatgaactttgcctgtcaaagcttgtctaggttaagggatgagcaatggcacagtgtcgtttaccccagagcatgaactgtttggtcctggttcaagccccttccccatttcccatgatactgggcctcacaatccatatgcaggaacagcagatgccacgtattgaaatttctagtttctctgccactaaaaatgatagctctgcttgcttgcaatatatgttgcctttgaaatgcacttgcagtgatggtctttcctatgcaagggcagagaagaaattgtctcatcagtatactttgctgaaccagctgaacccctcgcctacccagcagctctgtcacccccactgaggctggctttctagtgacgatgaacaaaggtggtcttcagctttctgatactagagagagctaggatgcataggccatcagagttaacttttgtatttctttcaggtcttcttgggtttctcattgaaacaaagcaagaagaataagcttatgatacccagcatattcttcagcactccagaaactcagaacccagcagataacgtaaaaataacaatgcggctgggtgcagtggctcatgcctgcaatcctggcagtttgcgaggctgaggcagacagatcacttgagcccaggagtgtgagattagcctgggacacatagtgagacccccaactctagtaaaaatacaaaaatatatccaaggatgtggcacatgcctgtagtcccagctacttgggaggtggaggtgggaggatcatctgaaccaggaggtcgaggttgcagtgagccatgtttgcgccattatactccagtctgggtgacagagtgataccctgcatcaaaataatgataaaaaagaacaacgacttttttttttttttttttttttgagatggcgtctccctctgttgcccaggctggagtgcagtggtgcaatctcggctcactgcaacctctgcctcccaggttcaagtgtttctcctaccccagcctcctgaatagctgggattgcaggtgcctgccaccatgactggctaatttttttttttatttattttttatttttttgtagttttagcagagacagggtttcaccatgttggccaggctggtcaggaactcctgacctcaagtgatccgcccacctcagcctcccaaagtgctgggattacaggcatgagccaccacacctggccctatttttaatttttttttcaacttttattttaggtttgagtggacatctgcaggtctgttacacaggtaaactgcatgttcctgaagtttggtagacaaatgatcctgtcacccaggtggtgggcgtagtacttggtagacggtttttcaaccccggccttcccactcccctgcatctcatagtctccagtgtcttttgctcttatcctgatgtccatgtgtactcaatggttagctcccacttacaagtgagaatatgtgatatttggttttctgttcctgcattaattcacttagattaatggcttccagctgcattcacgttgctgcaatgaacatgattttgttcttttttatggctgtatagtattccatgttgtgtatggaccacattttctttatcctatctgccattgatgggtatctaggttaatttcatgtctttgctatggtgaatagagctgcagtgaacatgtgagtgcgtgtgtctttttggtagaacgatttatttttctttgggcatatacccagtcatgggattgctgggttgaatggtagttctgtttaagccctttgagaaacctccaggctgctttcgccaggggctgaactaatttacattctcaccaacagtgtaaatgccttcctcaaggagtaatgcctagttagaaccttgcagtcacacaagaggtatacaaaggtaagagctgccacttcaagatcagaggccaaatgaaaaactttctctttagcagaacactcaagatgagcagacaaacctagtcacagccaatctctaggaagtgacgcacaattgacttaggaaaacaaagcaaaaaatgctgttctcagggctaactcagaggatttacaccaaatactgcctggggtctgttagatcaacaattaagatgaaaacaaaactttaaaacaaatggaagaagtttaaaggcacactctggcatgctcttggtattatttacaaaggagttttcctttcaatgttgtttataaggaaactccaagaagcctgattttagcatctatacaggccattatcatattaattttttgcattaaccaacactcccctcttttgaattttcacctcatcttaagttccttctctatgtattttaaaacctcttttgctgtttacatctcaacttcggatctttttcacacgccggcaggaggctgtatacatttaacatattaaggccgcagtgccgagttccctgaacagacaacatagctgtttgatcgagaatggagattttccaagtttgattttctaacaattcaccctttcccttgtacttgtgataaattccagttgtgtagtttaaatggtcattgaatagatgtgccgctctactctctacagttttaacatggttgaatgatctcaaaatgaggcaatcgtttgagcagaaacccgaagaggcctgggaggcagagctgcctgagactaatcctgagttcggcagccccaggcacttgccctcagacaggctctgagtatgtttgtagcaaagtgaccctcgggtcaccatcacctttttcattcttccttatgctcggagatagtcatctgactttgcatgtgcctaaaatcagtttagtctgatgcatttcatttcaagaaggcacaaagataggaaacctgaagccatagtattttgcttctttcctggcttagagaatgcgtcaagggaaggggccttctggtctaccaattctgcccttgttctttttttctaaaacatttcctttctcacagtgggagacagtctttgaaaacccaggtttccagacatggaagagagaaaccaagtattggaaatcatttcctactgcccagtttccccaattctcctccttcatgtttttttattcagagtcaagactgctggacttcctggtgctgttttgatctggtggaagagagagttgcaatatgactgtttgcttgttaaggagttggcagtagtcataccactcaggatgcagggtaaagagtcaagtctcttggttttatctctcaataatcataaaagtacatccattgatcccccactccattcccactggtgagagacttttgcttaagaccactgtctttcatggattggtgcaagcttcctgtggctctttctttttcttttctttctttcctttttttttttttttttttccccgacagggtctcattctatcacccagctgtagtacagtggtgcaatctcagctcagtgcaacctcctcctcccaggctcaaaagatcctctcaccccagcctcctgagtagctgggattacaggtgcacaccaccgtgcccagctatatgcccccgcaggcctcccaaagtgctaggattacaggcatgagccaccaggcttatcctcctgtggctctttccttccctctctacacccgcctctaccccattctgacaactgtagccccagtgacttttccattaagtaatgtctagccacattgcttcctactgaagactccccaaaggctcccagtcggagcacctcttccttaatgtagccctttctatctgacccctactcactgtctcatctaaactccagccacatcccgtggcttgttatttgcaaaatatgccatgtttttctcatactcagacttttatgtatggtatttcctctgctagaacccttctccacctctgttctgactcaacagagattacaactcttaggggaagctatctgtgaacctcctgccccagccaggttgcctgttcttccctctctctttccttgtgcttattccggtcatagggctttcatggtctgttgatgtttcctattagcagcctccttctgctagaacatgcacatccgaaggacaaaaaatatgttttatttacctattggctggcaaccatttaaatgtaagaggtaaaagagacgcctccacctatctgtacaaccttggctgtgtctcttaattctttatggacctctttgtatgtcttcacggttgtgtctatattagacagtgcccaccctacgttaatgccctatgatttgagattatttgagaacgtcatgaattggtccccgggctgtatttgaaaactgctgaatcacactccattgtgcaatgtcagccacaacttccaccattattaccactcaatggtggtaacaattccataaatgatgacaccatgaagaaagtaagggatggctaccgtgtgatcaactcttaacagatattttctctattacattacgtggctcactttcaggatattttcttctctattgacaacttaattctttacgactgctgtctcctccaggaagaattattgaaaagtaaagtgatgtttagaaagagataagtcaaagattgtttggatatcagctgttaactttttgcttcttacttgcaaaatagaatagaaccagcagtgttcactgcagcatttgtgggttattaataatttactcaatctattgatgcttgttaattgaagtcgctgagaaaagttagttaatgatgtgcctgcttacaccacattataattatgatggtagttcccctattattagggctgagtaggtgttcccattagaaaccttaatttctgagctgattgtcttcaccattttaaattacattgggccacatcttggcagacactttctgaaagcagatacgctcctttccaaaattatttttgtggtagcacagaagttctctccctcaaatgacagaggctgttaagtgtattctactttcaggaactgttttattaagctccaaccagcaatgtcctatgtaaacttatcccaaaagaaagatggttgctgaactagaggctaccttggcaaaaatcagatctcactgggaaagtaaatttttaaaagtcactcatagaatgggagatgggccacatttttcttgccttcacttggattcagaatggttctgattacagtcaacagaaaccaaattccaacgtatttaaactttatattttttgacagtgagatttattggctcatgaaattaggactgcaaaagatatgttgtcttcaagcagggcagggtaaaggggttaaactaatgtcactaatgtctttacttgttcgtcatccttcaactccctcctgagtgctgacttcattctggagcagatcttcttcacagggctacttgtagcctctagaccagcactccccaacctttttggcattagggactggtttcatggaagacaattttttccagggatgggaaaatggagggaatgatttcaggatgatttaagtcctttacatttattgtgcactttatttctattattattacattgtaatatataatgaaataattacacaactcaccataatgtagaatcagtgggaagcctgaccttgttttcctgcaactagacagtcccatcttggggtgatggtaggaagtgacagatcatcaggcattagattctcataagccacatgcaacctagctccttcgcatgcacagttcacaagaggatttctgctcctatgagaatgtaatgctgctgccgatctgacaggaggtggtaatgtgagctatggggaatggctgtaaatatagatgaagctttgcttgctcacctgctgcttacctcctgctgtgtggcctggtttctaacagaccatggactggtactaggccatcgcctgaggtttatggacccctgctctagagtatattgttgacagtccctgtattgaagcaaagcaaaaccttctcacacatgggttccatatataaaacaaaagaaggtgtcaattctgtttggatcacatcctcacccctgagctgattcttggagttagaaggagagtgaattttgatttccagtctataccatgcgtccatagcggtagcacaagtaggctgtgcatagctttagtaaacccacccatggaaagtattctatcagtggaaagagagatgttgctaccagaaaaactacagaagggataatggacaaaaattaaattataaatttactactccatggttgcatccagtacctaatcccaacccttggctgacccgatagccaaagaaattgccatcaattgttaatggttatcatagttcaaaactccattaaagattttatttcaactaggatctttaaaaattgtggccttatggtctggtgctaccaaagagttagctgtgcaatcttgataaagataggcagttaggttcactggatttcatttgcatcattgatagtggcttctctgtggtgtctgtcttattggaaagatgtgagtctggtatgcgcagatgtcagtgaaaaggaatttattttgctttggaaatgcagcatgggcaaaataagttgtgtcctggttatcttgactcctggaaaaatagtttagaattgttcctaatggggtccaggtacgatattttatgtctaagcatggtggaccattttccctccctagaagagacaatggaaggtgggtggcaccgagtcttgcatgaaggcacttaatcatttgcaagactcaagtggacataaaaatgcaacagagatgttttctgagaacaaacaaaatctaggcaaggagggaaccaaggagtggccattgctggtgcataaaacctatttattcttatgaaagagagtgtgttcatttgtgattctaatatatttttttgtttgtcatttggttaattatgtagaaccatggcatggtctaatattttgtacaaaacttgtctcttaatgttataatctggctggagagaaaaattaaagcagctgaatatcctcctttcctcctgttatgaatccgtctgtgtcactggtggacataatcattttttttttaaattctgcaataactcaactttgagtctggtaatgtctctatcaaatgcatacctggaggcatgggtcagaatctcctgaactttttcatgtttattgatttatttcatttgataaacatgatctgatttactctgtggccaaactataaatgcaaccttttattttagtctttccttcctgtcccaccttccaggaaaaatttggtttagggagggaggacatgtattggattgaaaggacatctgttggccgggcaaggtggctcacgtctgtaatcccagcactttgggaggctgcggcaagtgaatcacaaggtcaagagatcgagaccatcctggccaaatagtgaaaccccatctctactgaaaaaacaaaaattagccaggcatggtgatggtggtggggggaggggggcgcctataattccagctacttgggaggctgaggcaggagaatcgctggaaccctgaagtcggaggttgcattgaactctagcctggtgacagtgagacagtgtctcaaaaaaaaaaaaaataaggaaagaaagaaaggaaaggacatgtgttttattgttctgcttgttttcagttatcatgagggggaaaagtaccatgaggaagatgccctcaaacaggctatcagatgtttttgttcttgataccaggcaggaaagagatagaggtaaattgttctagttaggcattaaacctggttttaaaaaaaacccttttaaatgacgagaatggagataaagagaaaaagcattctgttgacatctgtgtggatttgattctcaatttatccatcatcattatcatagttgtttttgttactagtatttagcaacagatttgcttaaataatgggctagaacttacaggggaatattagcaggtagaaaagcactcaagattgtttttgcacatcatagttcatcatccaaaagttatttgttgagcacctatgatgtgccaagtgttgtgagactaagaaataaccaggatcatgttactgccttggaggatcttcattcagtcggaggaagacatggcagagatacttagttacaagctctagtgctgtaaaagagacaagtgaaagatacagaggaaagggaatcactcatccatctctgcctgggagattagaaaaactaccactgaagagtgtgacacacatttcatgtgaatgtgggaggaagtttgaaagatatggtcccatcacagaaggacaatagatctttcctaagatttacctgacaagaggtcatttgcttgaatctgctcagtgacaggaccttcctacaaggcagccatttttgcaggccttgagttgttagatagtcttcctcttgttaaaactatttatatttaaacttgaaggcatttagaagatactgaaaatagtgggcagttgtaagaaaatgtgattggagaggcataaaacttagtttgggaaatggctagaccctcttcctttgtgtgtgtgtgtgtgtgtgtgtgtgtgtgtgtgtgtgtgtgtgtgtgaatatttgcatgtaccacatgttgtatacatggagcatcagtgagtatgggatacatattttaccaaatgctttatgagtattatttaatgttttcaacaactgtatgaagtttgaagtttgtattgttatgaaacccacttcataggtaaggaaactaggattacagagttttataactttgcataatgagtgagagaatagggatgttaacttttctttaaataactgtatcctcagaataatattttgacttgaattaggtagattctgtacagtataaattgctattgagctggaatattttgtgtggcggagggcatcttatgtgtgtgtgtttcttcaaggtatcaatgcaaactctccaaagcctcttgtttcagaaagataaacaactgttatcagcctacagatttttgaagaggctgagtactaccacaagatttattttaaaatcaagctgaaacaaagtttttagctttttaaaaaaattaattttgagagagtgaacttcatatcatcacctttagagttccagaatagcaagtcttgagaaaggaatcgagagttggaggattggccaggtacagtggctacttgtgatcctggcactttgggaggtcgagttcagtgggtcacttaagccaggagttcaaaaccagcctgggatacatggaaaaactccatatctacataaaatgataataatagaaaatagcaaggcatggtggtatgcacttgtagtctcagctccttgggaggctaaaatgggaggattgcttgagctcgggagttgtaggttgccatgactggagattgcaccactgccctccagcttgggtaacagggtgagcacttgtctgaaaaaaaaaaaagagtagtggaataagagaaataccaatattcccaggaattgggccatggaagagctatcagccacttgccttcctcccttctcctcccaccaaaaaaaaaaaaaaatatatatatatatatatatatatatacacacacacacacacacacacacacatatatatacagacacatatataatcattcagctattctaatatttgtatatgtaaatgtgctctatataatacctatatatgtgatgaaccatatgtagtggtcataaaattggatataaattttatgtctctataactggacattaaatctcattcctataccccattaaaaactgatctatttttccaggagccaaaataactatgtaatatacagatatgttttatatatatatctacacacacactcacacatacacacacgcacacaggtatataggtatacatgtagatagagtttcaccatgttgctcagggtggtctcaaactcctgggcttaagcaatctgcccactttggccttcaaggtgctgggatcacaagtgtgaccactgtgcctggccgatccctcaactcttgattcctttctcaagacttgctactctggaagtccatatatatatatacacacacatatatatgtatacatatgtatgtgtacatgtacatgtacatatacatgtagatataggtagtgtattatacatatatagacttgcagcatatgtatatacatatctgtacatatacatgcacatatacatatgcgtgtacatatatgcacacatacatgtacatatatgtgtgcgtatagttgtacatacacatgtagatatgcatatatgtgtacatatacatgcacatatacaggtagatacacatctatgtgtgcatatacatgtacacatgcatgtagatatatatgtgtacatatgcatgtagatatacatatgtgtacatatgtatgcacatttgcatgcagatatacatatatgtgtacatatatatgtatatacatatgctggaagtctatgtataatacactacatttaatttttaatagttttagtagttctatagtattcccttctatgagtgagacatttaatggattccttattgatgcatgttaaatggcttgagttttgttgcttttctacttcaaacactgcatctgtgtatacttctatctctctgtacttgtacatgcacaattataggataatttcttatttaatggctagatcgatttacttttcatagatattgctaatatttgccctccaagaaagttttatccgtttacattcctataatatatgtgataacctgttctctttacagcaaaaagtgcctttaaaaaaacacttcccttataacaaacatacatcctctgctgtcagattgtgaaaggctgaaggaaatttacaaggagctctcctgtttttcccctattatacttgattatgctactaaatattcagccacttccatgctattgagtgtgggagaaagcaatcgtattctcattggcacaggataagggaagcaaactcacctgagcatcgtttcagccttagaattgcaggctggaaagcctctccttgtgtgtgtgcattggctggcagctgcctgccatgaatgctacccaggctctcaaaatgggaagaagaccatatgcttgattactaaatgaattcacaggacaaactatcacagaaaacatgtgtaatatgagataccatttcaatttggcaataaatgtatggtaaatggaaggttgcagcccatgtaaaatgcacttaggatctagtgttgccatggagtcaaaggaaatgttatggcagcagataggtgcaattctgccctggaatttggcactctgggattcgttgggggcctgtggaactattcagaatccagtgaacaccaaccatggggctttgcatagcttaagtccaggcacgtgaaaatatccgaatagggtctgggagctctgaatttcaaatatcattggttatttgatctaaactggattaaggtggtggaaatgacagtatctctacacgccatagccactctacatgcagtcccacgcatcacctcattttgtggtcactgcagctcttcactgggcaagtggaaacagcttcacaaaaatcagactctaggcaagaaattggatttacatgttttccctttggttttaaagaaaatgtagataaaaatctgatagtctacttcagggaggacaaatatatttcagcttctctgttcactttgacccattggtagagacttccgaggagctgtgtttgctttttcttaattaagcatttaatgttgagatgattttagatttgtagattgacaaaaagctgtaagaaataatacagaaaaattctatgtagcttttactcaggtttatccaatagtaacatcttgaaaaactacagggttggctgggcgcggtagctcaagcctgtaattccagcattttgggaggacaaggtgggcggatcacaaggtcaggagttcgagaacagcctggccaacatggtgaaaccctgtctctataaaaatacaaaaattagccgagcgtgccggtgggctcctgtaatcccagctacttaggaggctgaggcaggagaatcacttgaaactggaaggcggaggttgcagtgagctgagatcacatcactgcactctaccctggtcaacaagagtgaactctgtctcaaaagaaaaagaaaaactacagggttagggttatcacaaccagtgattgatcttactgatgtagaaagatatactggtcttatacagacattgataccacctactgatgcaatctcctgacctttttcagatttccctagttaaatttgtactcctgtgggatgtatgtttgtctgtgtgatgtgtgtgtgtttactgtgtgtatctatgtctgtgtggtgtgtgtttgtgtggtgtgtatgtgcctgtgtcctgtgaccatgtgtttgtatgatgtgtctgcatgtgtgtgttttgtggtgtgtctatggtgcgtgcacgcacgtatgtgtgtatggtgtgtctgtgtgtttgtgtggtgcatatgtgtgcatgcatctgtttggtgtgtgttgtttctgggtggtgtgtgcatgtctgtgagtagtgtgtgtgtctgcatgcatatgcgtttgtgtggtgtttgtgtctctagtgtcagcacttgtttgtatggtatgtgtgtgtgcatgtgtgtgtatggtttctgtggtgtgtctttgcacacgtgtgtgtaattatttgtattacaaacatttatcacttgtgtagtttcatgtggccaccaacacagtgaagatatacaacagttccatcaccacaaggatccctcagattccccccatttctctcacccctacccccgtccctacctgctggcaaccactaacctgttcttcacttctgaagttctatcatatcaagaatattatataaatggtatcatacaggatgtaacctttggagactggcttctttttctctgcatactgccctggagattgtttcaagttgttgcatgtgctaatagttgattgtcttagattgctgagtagtattctatggtgtcaatctaccacccaagaatcttttttcagtagacaccctgaggctgagcaggagagggtgccattgtcactgcgtcatgcctatcccagagacagggattgagaggggtggcaagcccctggtgaacctgcttggcttacatgtatgtgctgatatttgaaagagaatcagaaacgggacaggattagcatctatgtcactctagagatcagtatccaggattcagaagggtcatgagggctgtcactaaggggactagtgataggctggaaatcacgctccatgcgctaggactatagcttccatggcagaaggcaggatttgaacatgagtccccagccactttttcagtgatctctctactccgctatagcttcagtcatctcccgcttatcgtgtgtgtttgtgctggttctggagagcgcacaatttgcagaaggcagttttgtttggatctgccaagtacaaatgtggctggctagtctgttggatagcctgacaagacccagaaatttctgtctttcctccctcccatcaaataactgggctcctccaagagccaacgcatacatcccacctgtaccaacagaatgttgtagtttgcatacttggaatggaaaaataatatttggcttggctttgatcatatatactaattattgctaatataggcaccagatgattgcattttattatacctttgtttttcactaaatatcagaattccttccttgaggggggagttgtcatactacttaattgttttgtgttttcttgacatatctaagcattatctgtgcaactgtgtcagtgtgcctgttgctgtaaatattcaagggactcataacagtattagaactaatttcttaccacaacagaatattatccctttcataattttcaattgtttcaaaggaattctgaggattcttggtttccaaacttcatatgacttttgactttttttttttttaataaagtacagcaaagagttttatgactatgtgctttagaggccagatggcattgttttcttcctgtctttggcaggtttcaggcaagttgcattagtcttctggactttgactgcctagtgtgtaaaatggcaatgaaaaagtaaacgaataaaccagactttgtttcttcttctcttctgtacttttcatcttcttcctcctcccttttccttccttctttcgtaaggttgcacaaaataatgtacattaaatgtgtaacgtgcagcatgaactacattttatacatatagataaaaactgttatacatatttttttatttgtgtcattaacttgttcttgttgattcaatgaagattacctgcagttagctgaaaagtcgtaatacaaacaattattttatggctttcttttttcagtatgatttacactgtccagttatgtctttttgaggcataatcttcatcttagttttcctggggggtttttctgtaactcctgtgctacattttcaggcagtttcttaacataggtacctatgtctattcctcctcctcctccgcctcccccttttttctccctcctccgtctccccctttcttctccctcctccctcctccctcctccttcctcctcctcctcctcctccttctttttcttcgttcaatcttggaagctttccaattcaactctaacttcttcagcccgtcttttacttatgtgtagctaataccacatttatatcagcgacaaaccttcaatggttaggaaaaagaagctaaccctttattttctctttagatgtgttggtccatttgttgtcagtgttttggttcaggttgttcccagctacccagatgactacctttcatcatatttgcagagtgtatttagtgtttacatcaagaccaacctctgggattacaaaataattttataccactttctatctctgggtgattggaagtggctatctgcagcaggactatgtggatgatgatgaggtcataggcaggttcgtggagaaagagtgctatgattgattaatgatgtctgctgtgaccatgagataggggaatgcagtatgtgtaaggaatatttgctaaccgttttaaatgaatgttctttatgcttttagcattgctttaaaatggataacaaaattcatcatatatttgctaaatacacattatacctaagtgtataaataacatttatacctaagtgtgaggcacttgaaaaactcttctagtcattattgcctgtaattctttcttcactcttaggggttaggaatcatttttaattcctattttacagattcagaaagagaggtacatgtcagtgaagtcctttgctaaggctgtgtacctactaagaatcagatttaatgtttgaatctcggctaagtaatcccagggagctttctatggaggtaaggaagaggatcaggttcacaaatgcagaaataagtgagtttttctagtgagggtttctgtccttcatttgagcagcttcctttatgactcatctttctagaatcttgcaagaatacaaaccaacatttatagaggtgatttcagcacaagcactggatgtttagaagtttctagtcagtcctaaagtgagaagacagaacacgttcaattgatttccatttgcagtgcccagaatgagaaaggtgatgtttattctccctggtaaacacactcaaaggttttggggttacccaagttgagctttccaggcaatgaaccactaaaaacatatttgttcccagaacacagccagctagtaaggttttcccactggggctgacatttactgtaacaagagcctgtttccttctctcagagctgcagccagctcctcacaagggagttggtgtcttgccagagaaacccctctaagctccaagagacgtgccagggaagccagtgcttttccctttagctgaatgtgccaataatggcagaatgatgtctgctttttaaagtgacaagttaaaatattatctacaatttatctgtccactcatccatcatctacttatatttcctctctctccatatgtatatatatgtatacacacatacatgcacacatatgtatgtatatatctatttggcgaaatgaatatatttgctcatttaatatcacagtaattctataaatataatttagcaaattttatgatgctccattgtgcaggttctaaaaatgataaaagaatctagacttctgggcgcagtaactcacgcctgtaaccccagcactttgagaggttgagggggatagatcacctgaggtcaggagtttgagaccagcctggccaacatggtgaaaccctgtctctactaaaaaaaaaaaaaaaaaaacattgccaggtacgcgcctgtaatcccagctactggggaggctgaggcaggagaatggcttgaacctgggagacagaggttgcagtgagctgagattgcgccactgcactccaccctgggtaacagagtgagaccgtagctcaaaaaaaaataatccagatttcatgatttctagataaatacaaggcaaattgaaaacagctctcctcctcctcctctttctccttcttcctcatcttttgttgttaaagaattatagacttcaaagctggagaagcagtgtggggtattccctggtcctccttccaaatgcatgttgaaatgaagacatgtgggttttcttcccgttttggccatcacctgacctaatgaccttgggccagtcacctggcatctccacgatcctgttacattgcatataaatgcagacttctttgtatgatgtctaaggtcacagagcaggtattatgcccatcttgtttatctgccaagcacagtagggcacccataaataattcctaagttactgaatgcatctgcagctcaacacttttgacatttttttttctcattttaatattggccaactgagatttgaaaaggttttgacttgcctgagttaaagcagggggagtctactggccaatttcttttgactattacgttgtttgatttggacgaaggggcagggggttgtataaacgtcactgtggagagcccttgtcccctggtgatgagtaaccttatcaatccagagcaaagaggcatgtgaggagattttgctttggaaaatggcacacagttgaggaaatttcatcaatgtgtatgaagcggctggtctggtgacgttttgctttgcaagtgggtgactgacatccttcaccctctgatctgcccattctctcctttggtccttctgttcccgttagcactccctttaacatcagtctctctccctcttcttccacctagaatctcaataagctctttcatcatctcagtttctacagagcagaataagctgaggacttttttttcaagttttatttatgtgtttttctgtttttttaatttaaaaatttaatttttttagacagtcttgctctgtcacccatgctggagtgcagtggtgcaatctcatctcactgcaacctctgcctcgtgggttcaagcgaatctcccacctcagtctttcaagtagctgggactgtaggcgcatgccaccacacccagctaatttttgtattgtttttggtagagatgaagttttaccatgttggccaggctggtatcgaactcctgacctcaaatgatccatccacttcagcctcccaaagtactgggattacaggtgtgagccaccgcacacagcctgttttttctaattttaatttcagcaggtttttggagaacaggaggtgtttggttacacgaataagttctttagtggtgatttctgagattttggtgcactcttcactaaagcagtgtacactgtacccagtgtgtagtcttttctccctcaccccctcccaccctttacccagagtccccagaatccactgtatcattcttacgtctttgcgtcctcatagcttagcccccacatatgagtgagaacatatgatgtttgcttttccattcctgagttacttcacctagaataatggttttcagctccatccaggttgctgcaaatgccattattttgttcctttttatggctgaatagtattccatggtctgtatataccacattttcttgatccactcattggctaatgggcatttgggctggttccatatttttgcaattacaaatagtgctgctataaacatacgtctacaagtgtcttttttgtatagtgatttcttttcctctgggtgaatagccagtagtgggattgctggcagaaatgatatgtgtcttttgcaaaaatccaaaccagaaaagagtaaaatttatatactatgtgtgaaaagccccctctaaatcctcttgtctagagaaaaccacttttaataacgtgtaatttcttttctgtgtatacacacacacaaatacaaacacacacaatgacatttcaaaatcgtgtgcacatcacatttctattcagttttcccctacctcatggctgtatagaagtctgttgttaaggtggtattataatttaatcaaaaatccaccttctgatcaactaagttgttctcaaccttttgcttttaaaaacattgctgttgtacttctttgtagacattgtcaggtaactgcaggagaggcaataaattttaaatggataagagaatgaattgtttgcttcttgaattaatgctttgaatcatcaactggaataggatatggagttggcagcgtgtatcacagtaacctctccctgaatttggagccctataaaacaagttgtgataatttcagtcatttcagaaaagcttctgggtcataaaggagagctactattccaaattcccacctttgtctttggtagccaaggatgcaatcctgtcagtagtcatccattttcgcaggtatctgctgggtccctacttgtgttgaatatcatgtcaaaaactgagcaggaagggattagcaagacagtctctatctctgccacaggtgtgacatgcagtcgtgaggttgtgcattgctccaagatgcctaagcaagggggcagagagggtgacacaccttgctcacaagccatgcaccctggaatgggctgtgcccacccagggtgaaaaaatggacttaatggctactagaggcccagatcataactcttctgtaataataataataataataatgataataatcattattattattattattttaccatttgagatggagtttcgctcttgttccccaggctggagtgcaatggcatgatctcggctcaccgcaccctccacctcctggaatcaagccattcacctgcctcagcctcctgagtagctgggattacgggcatgcaccaccacgcccggctaattttgtatttttagtagagatgaagtttctccacgttggtcaggctggtctcaaactcccgatctcaggtgatctgcctgcctcagccttccaaagtgttgggattacaagtgagagccactgtgcctagctcctctcctggaatgattagatttaactttgttctccaattcttagacctgtgactctgaatagggtggggatgttcatcttgatttgccttctgctagaccaggaatgaagagatggatgatattactccttttgatgtttttattcttgaatagatatgttggattctctgtctcttgccccctgcaccccaccgcatgcacatacacacacacacacacacacacacacacacacatacatacatacaccccagatttcctttgaaggagtgcatagtctatttttgttgttgttgttgttgaggtggaatctcattctgttgcccaggttggagtgcagtggattgatctcagcccactgtaacttctgcctccgggattcaagtgattctcctgcttcagccttccgagtagatgggattacaggtgcatgccagcacacccagctaatttttgtattgtcagtggagatggggttttgccatgtaggccaggctggtctcgaattcctatcctcaagtgatccacccttgtcggacttcccaagtgctgggattataggcgtgaaccaccgcacccggccggagtgggtagtctttattcaagaaaattcccaaatcagcaaatagcttgtgagcttacaggtgaggttctgagggagtgggttgtaaggaaagatagaaaactatagaggagtccatgaataaatgtgattcagaggggagggggaatatgaaagagaagaacagggtgggtaggaagatcagaggttggagaagaaggaacaggatggcctcaaagaagcctagagctgaggtggccagagcatggttaaggacagcctcgtcatcggttatgggctgtgtgccttgttgttgtcatggactggccctccttcgacacccctgagcagtctggtgaggaaggggtgagtgtaaaccatctttgccccagtctgctgtcagccgatgcactaggatgactctaaccggcatgtcaaggcagacttcagcagcatccttggatgagtgcgcactgggtggatacaggacagacagccaaaggagtgctgctccaacccatgcggcatctctcccaggttgtgaaacaactcgggggtggtgcaggatccacgctggggactgcacagacacagccaccagtagccttgctctcatttgagtttttctttctttactgatgacatcagagagaaagccccagattgctgcattggtgttctttttttttttttttttttttttttttttttttttgacagtttctttctgtcgcccaggttggagtgcagtggtgtgatctcagctcgctgcaacctccgtcccctgggttcaagcgattctcctgcctcagcctcctgagtagctgagactacaggtgcctgtcatcatacgtggctaatttttgtgtttttagtagagaagggatttctccgtgttggccaggctggtctcaaactcctgaccttaagtgatctgccagcttctgcctaccaaagtgctgggattacaggtgtgagccaccacacctggctgaaaataggatttttacggatgtcactcattaaggatctctaggtgaaatcatcctggacttagagtggaccctaagtccagtggctggtgtttcaataagagaaatggagggagatttgaaaacacagagactcagaggagaaggccacgtgaagaccaaactagagctaagagtgatgcagccacaagccaaggatgccaggaccaccagaaactggaaggaacaagaaagaccctcccatgcagtctttggagggagtgcgaccccgccagtaccttgctttaggatttctggcctccagaactgacagagaatacatttcttttgtttcaagccacagtttttgataagttgttactgcagccctaggaaactaattcactagagggctgcaaactaaggcctgagagccaaatccagcctgacacctgtttttgtagattttattgacagaaacacagccttattcatttacgtattgtctatggctgctttcactctgcaagggcagagttgaataactgcgacaaaaaccatctggcctgcaaagcctaaaatatttactatctggccctctgcgaaaaaagtgtgccaaccgctcttctagggaggtgtttaatttatgtgcttgtctggggatgctgcggggtaggggatgtttgtagtgagagtctgtctttaacagcgcagaaccacacaaggtaaggattttttttaaacttacatttcaatttttatgaagcaggttttttcctccttagaggaaaaacatgaaatgttccagaatagttgacagcattagctacatttaaaagattcaaggaagcaaaatggttttccgtctgttgaatcagtcagcattaaagttcacttatcaatgatggcttttctatgagcagcagctttgtattaaaatggctaatgggaatgtggttcccctagcaagctttggtttgatctagaatttttggagagtctgagtgggttttcttcttctcagcatgaaatggaccaaggtctgttttgcagctgagacataaaggaagtgaaaccttgtctgatatgtgctagggtgcagagccaggtaggaaatgggaaagagtgtacctcaaacctcaacagccacattgtccaccaattctcattgcatgtgaattcgtgaacctcattggcgagctcaaagaggtggctataggaaacctaattataagcatcatttggctcatactggtacagaaaaccttcaattaagttgcagaaaaatggccacacacagaagaaagaagttagaagggtttttctggtattcttggtttacatctcagtggaagcaatttttatgtcttctgcatatttcactgagaagcctccaccacttctagccataacttcctttccttcctgttacaaattttcttcctagatttactcttcagtccctaaaaatatccataacacattatttattcactccataatgtacaccatccaaatacaacaattttgccaataaactgttattctaatgaataattcatgcagtcttcattctcctgacatgaacaaatatactttcaaataggaggagtgtgcctctatttttgtcttaactccatttcttaatgtcatatatatttttaaaggtttgtgatgtccttccttggatgaactccatggggaataattctgatactctaattaagagcaataaactatagcacagaaatataactagatttatagacagtgtttgttacagtgacagtgtagtttgcatgtggagggaggaagtaggcaaatcattcagtgtctcagggcaggaaaaatgtgaagttctcacctattaagaaggcaacaccaataattgtttcaaattttgacaatattcatggccatagtttcctcatatttatatgaacaggatgtgatgataatggtgacgatgaaaatcataataacatattattatgtgatgtaatgctaagaattttgagtttctatgagatactagccatttactaaaagctttgcatatatcagggtttctgaatctcagcactatgggtatattgggtcagataattacttgttatgggccaggggttgggggatccactgtgcatttgcacgatgtttaacggaatccctgacctagggtatctgctagattcagtagcacctgcctcttcaagttgtcacactgagaaatgtctatagacatggcctaatgtccccaggagggtaaaatccccttgtagaaaaacagtgatgtacatgattaattgcatcttcaacacattcctaccaggtaggtgcattatcagtcccatttaccagtgaagaaacagaaattcagagtgaatgacagaaccaaattttggtgcagggtttactactacaccaatgtcaagactattttgttgcatatgatgatacagagcattaattcatctgccttctcctcttacatgggtattttcacattttaaaaatgtataattgcagggtgcagtggctcatgcctgtaatccctgcactttggcagggccaaagcaggctgatcgcttgagtccaggagttcaagacctgccctggcaacgtggcaagaccctatctctacaaaaaaaataaaaaaaatagctgggcatggtgacacacgcctgtggtcccagctacttgggaggatcaggtaggaggatcacttgagcctggggaggcagaggttgcagtgaaccaagattgtgccaatgcactctagcctaggtgatagaggaagaccctgtctcaaaataaataaataaataaataagtatttggtgtatgcatgctgggtaattaatatatcttatgttttgcacagacagaacttcaaatttccaaaaccccttttatagaaactgtagcatgatgaccagattaatactttttaaaacaatagcaataataacagtaacaatttatcctcctgctcctcaccactgttaattgagcactctgtttttagagatggtgtcttgctctgtctttcagactggagtgcagtggagcagtcacagctcactgccgcttgaactcctgggtgcaagtgatactctcacctcagcctcctgagtagctgagactacaggcacaggtcaccacacccagctaattaaaattcttttttttttccaagatagagtcttggcgtgttgcccatattggtctcaaattcctcagctcaagtatgagtagatgggattgcaagtgcgagccaccacttctggctaatttagcactttccatgtgagaaactaaaggatttgactggatcacctgtttaattctcacatcttagaggtacccactttgggtatcttttagccctaagctgtataattcagagttgttttgttttctttgggtttggtttctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatcaaaacgtccagctctgctctcagccatctggttgggtctgtcttttatgactttatttgtatatcaggtttccttttgcaggtgatcctaaaacacacactctcccgtcttgctccagtctgctcaccctctgcctctcacctgcgatgtctccttcatttccatttgtctgaatcttatttcttgttggaggtccagctccatcccagctttcttcccaaaccctctccctatgtcttgggcactctcaaggccttacttgccaccattgccagtcggcaattggcgaggagctgcacaaatcacaggcacccagtactaactcccaggtctaaccctccatgaactatgctcttaggaaagcagcttaaagtccttgaaaccccaatttcctcatccctatgatgaggactgcagtgtcattgtacatcccaatttgctgtgagggttcagtgggaaaatgcttagctgagcacttgacacatagtattttcttgatgaattcctgccaccgctaatgtcactttatccctgttttgtatgttccctggttgctttatgtatgtgtgcttttgaactagattgcaggattatagaaagagatttctttcagtgtgaatccttaatgtgacacaaaattcagcacaaggggtaaaactgtggccaagaggccgcctcagtgtttagaatgtaattttctctctttatgttctgaaccgtggtgtctttatcaatgacatggaaggggccatttccatttacttcaccatgccagaagggccattgcaaatggatttagttatagggtaagcaatgagcttgtgttttctgaacagctaagcctcagaactgtaataactcattatcaatctgtctccatacttcatcaaagttcccaggtgctttgaattttggcttggccattgtctttttttagctataaaattttgcttatcgcatagtttaaagtgggatgatgactgagacacatctctgcttatgagtaccacttaagagaggatatatcctcaggtagaacaatttccagagaggagatgtgggcacggggtctgtgcctgccctggaagctgtgtagtatagtaggaagaatcctacattcacagagaggctgatttttgcttccagttttgtcacaattcacatgatattgggcaatttagaaaaaaatattgatttgctttaacgttctcatctgtaaaatgaaacatcccaattagataagttataaatgacctttcatttttagaattctgcatcctggaattaaagtgcattggaatgagccaataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggagaaaaaaaaaagaaaactctctcttacttactgggaacacacatcatgccaagttgtagcaacagaggcagcacaaggctgaaagcaggaggcagagggggatcttgacacacaatgatgagttcacctacatgggggctcaggtggcagacacagaggtgtcagtcttggcttttaaaagtaaaagttggcttcccaatgtagagttaaacagatggcagagtgccttctgaagtgagggtttagagaacatggggagatggttatctgcctcaatttgaaactgacctgccatgagattcccaaggaagagacttgaatatcctagagcagttaactacaaaactaaaatttgccccctcagtatggttttcgtgtaaaagaattgcaaaacaaagaaaaactaccacgtgtgtattttccctagaatttcctggtagaaataagatattagtacccaacaagtagaaaagaatatgagttcagaagaaagactagggtttagtatcagacatactttttgattattcatatttcataaaatcttattttcttgacttataacaaaaatcatacaactgttttattattaacgtaaaattaaagaaaaacatcactacttttctcctcccccttttatttcaaattacgccactgactacgaaaacctggtcaaatccaacgtgcatttagaaaccataatttgaagaaactaatagctggagctcagtgccaccatccacaacagatgtccttccaaactccattcactgtcatgctataaaacagaattcagaaacaacagggtatacgtatatatctgtgcattcagtgactctgaaagggaggcactggtttcgaatgttttgtgtgaacacgagttccatttgacacttttttttttctctcagaagtcattttgtctcattccttgcttacttcattgtatttcagcatttgtcatctcaattacagtagtgcatactacttttacacttcaactgcaatattcagaaacaccagggaaagagcagtaaagatattaggaggtggtaattaagactgagaatggctccagaagggtggaaacacatttaggatgttttttattttaatcatctgtaaagaaactaattccataggcccatctacagttaagttccacttgcagcacaaagcatcataaattgaatagtaatattctttatcccaatgtcatacaactgttgtcctataatactgtgacgttgaatcataagacacacgttaaataacctattatgctcagtggtttctctgacagttgaggatgagaccaaaacgtatcccaccctgggtgacgcagagaaacgaaatgaaagacaaaccatttggtcttccaagaaagagttcagtcaatcacagtgaactggttggagtatattcattaaacaaatatttattgagcatctgctttgtgttaaatgctgaatggtgatttaagctctagatttgcctttcctggacaggttgtagaaataaatccacacaatgtgtgatctgcatctggattatttaatttagcagaaagtttatccatgataaacttttttttttcgtgaacatgaggatgaacatgaggttcatccatgtggatgcatgtatcactactttgtttctttattattgagtaatattccatggtatggatggaccacattttgtttatccatttacccatttattgatggatacgtggattgtttccagattttaactattatgtagaatgttactatgaacacttgtttccaagttcttgggtggatatatgctttcacctttcttgggtagatatttaggagtggaattgctgggttgtatggtaagtttaagtttgagcttaagaaaccactaaactggctgggcgcagtggctcacacctgcaatcccagccctttgggaggcagaggcaggccaatcacttgaggtcaggagtttgagattaacctggtgtaggtggtgaaaccccatctctactaaaaatacaaaattagccaggcgtggtggtgggtacctgtaatcccagctactcgggagtctgaggcaggagaatcacttgaacgcgagaggcggagattgcagtgagccaagattgcgccattgcactccagactgggagacaaagcgagactcagtctcaaaacaaacagacaaacaaaacaaacaaaccattaaagtatttttccaaagcggttgcgttattcaatatccccaccagcaacatacaagcatccaggttgtgccacatccttgacaactatttgtattacttatctatctttcaaattactgccattctagtgggtatgtggtgatatctcatcatcatggctttaatttgcattttcctgatgtctaatgatgttgagcatcttttcaggtgcatgatctttatgtttgtttattttttatttttaattctggggtacatgtgcaggatgtgcacgtttgttacataggtaaatgtatgtcttggtggtttgctgcacctatcaacccatcacctcggtattaagcccagcatgcattagctctttttcctaatactcttcctcctatccaccccagcccccaataggccccagtgtgtgttgttcctctccctgtgcccatgtattttcatttttcagctcccacttataagtgagaacaaagtgcatgatctttcaatgaaataaccttcttcgcctgtgaaatgggtctcagtgaatcttgaggaatcttacattactacctataatttcctttcccttataagtcagcaaaggcatgggcaggggcctgaagtgggagaaagagctcctccccctttaacgtggattcagaaatgtgtgacagggagctgagactttcgctgcctggtcatactcattgagcctatgggctggttgtgtgaacatgccacaggtaggcacatagggctcataggcaaaggatcccatttgtgcataaggcacactttgaaaggtagggtttggatccattatctcaccccaacagctgtgtgcctccagtgtgcagcttgaaagccacgtgttaccctgtcagttcaagcttcccgaggttacctcttccagccacgcagtagttggtattatttctttcatttttttgataaaatgtcttcctctctccttctcagagtaaagcaagtctctgcacatgtttctcagctgggttgcagtaatctaggaaaaggtcactctttagaggagttgaaaggactccaggttcttatattagccctctgagcatataaaggcccaaagaaacagacaccaattcctctgctgcacagacttttaaacctggaaagctgtaaatgcagaaacttaagtatctgggaggtgcgtgcttagcagccatccgatgtgagtgtcagttcattttgacatgtaaccaagatggacctcagccaatagcagtctccactcacagaccgctggtgtggttaggagcatgtacttttaatcaaattttttttattggaatcccggtgctacatgctaggtgtgtgattttggacaggctccttaactgtgttagctttggttaatgaaactgtaaaatgagattaataataattcttggttcttaaaatcatggataggattacatgagataatgcatgtaagtgcttagcaccattttgcatttctttagcttttatcgtttttatgttatatttgattttacatctttggcactgggaagaatgcctggcatatagagtgtactttgtgactataatttgaccacacacagttaagatattcatttatataatagatatgtacgaggtatctattatgtgtacgaggtatctattatgtcagtaaactatacctctcgggaaaaatccagctctcctcttgtttttgtaaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagaggaaaattttttagatatttcccatttaaatgcctctaatctcagaatagaattttatagtatcgctttagtaattcatttacaaggtagttttcaatagaaaaataaaaactcactaccccatgaagtctcattgagcacaaaattcaggaaccaccccaggttgcaaataaattcagacattgcctgtcataaaaagctggttcggagacaactccatttagtattgtagaactgtgcaaagaacacgacactttgctgactggcatgcatttttgtccaggagtagttttccccacatggagaatagcgacaatacaaccgcttccaatcaaaggggaaatttgtgctccttatctagcttgattgtccatggataagaccaagttcaaaagtgtcagttctacaagcaaacaaacaaaaagccctgaaggcctcaagagctgaggatgcaaggaacaagtagagtttccaacacagaggaatgataaatgctggaggtgatgggtagtgtaaataccctgacttgatccttaaacattctatgcatgtaacaaaataccacaagcacactgtaaatgggtacagatagtatgtatcaataaaaaaaaaaaagaatacaaaaagaagtagatcagggatgctttatatggttttctaccttgtgtcttattttcaggtgtgttttcacaggcactacctttgtagaacaggttgcttgctgtgacagctcctatctgagcaaattgcattattaactagattgaaccaggaggtagggcacttccacaaaattctaggacaggggtcagcaaatctcttctgtgaggagccaggtcataaatattttagattttgcaggtcttttggtctccgctgcaactcctcaactcttctgttgtagcacaaaagcccctgtggacaatgcataaatgaatgagcatggctgtattccgataaaactttagttacaaaagcagacaggatttggcctgtgggttgtggtttaccagcttctgttctagtgtagtttttccttttgtaggtgtgctcagaagatcaactggagagcagacacaacatgctcacgctctggttcctttcttctgacctattgattcagaatctctgagagtaaaggccagccatgtacacttgtactgttgtacagatgcagaaagtcagtatgtgtcaggatatgctgctgttacaaataacccccaggatgtcagtgacagcagcagcagcaacaacaacaacaaacaaaaaacatgtttattccttgctcatgcaaagcccaccatgggcatctctagggaaactttcctccacacagtgacctagtgattcaatttgtcagaggcactatcagcctgtcgctttagtttctgcaacacacagccttcttgattgacgtcactgagaaaaaccaagaggagaaggtcttccaatggtaattaaatgactgggtcactaacaatttgggcatagctacttgcaaggacatggcaaacacaatcttcccaagttcgcaggaggagagagaaattggatatgggtaaacactaaattttttttattcgttcataaattgattcaattgatgtatcgattgactgataatcattactaaacaatgtgatgtgtgcatggcaaagaacctatctgcatggtatttatgggtatatttctgtttccatcaccagaatttaaccagttatctacataagtgaaatctgaaaggaaactactctttagacctggggtcaggcaccttttactttattatactcttctacttgatggtaaaagtcattatcagttttgttaatcacatgccggacctcagatgtattgctgtcctaaaaagtcaagcacattatactgaccaaatgtgctttgatcacaggtgagacatcgggtttcacacctgttattctgcaagttatgtataaggaacatacttcatacttctttacttcctgtactgatccagtttggttggttttactgatttggttaacaagatcgtaaataatagtgaagtctctctctgtttatggttaacactgctggcccattataattttcggtggcagtgcatatggcgggtgataaactaataaagctgcagtaggaagaatagttctgcttttatttttatggctatttctttaatctgatgcataattaatgtacaaagttcaacttcgttttggtcagatcccagattactcgaggcatccggaggggttaatattttttggtgcatttgggggtaggaggttgggataaaacaacaaatttttatctatatggaaggatgcttaaccgggattttttttttttttccaaaaagaaaatacttaagttatccttgctttcagagttcatgtccattggaagtgtcaagagattctgtgttcaaacattctcaaagcaccgctttccccttaccccttacctaagagaacataattctaaaaatccctttggggaataattttctctgccttccatctctctcaatgatgtgtccaatctccacaatttgtctggcctcctcttgaactgatttacggttcaccaaaatctgtgagaggatttgccaggctgcagaccaattaattatgtttgctgttagacctgttaggtgttggcatttccattttgtcagacattttaaatttaacgtggacacatggtttccttttttttttatatattaaattaggaagctgaccacatagggggagattccaacagcaacacaatgaatttatttgagatgcattgtccttcatttgtatatagaactctttaaaaagaaattcaccatcttcccagatttttttttctttttgtttgagatggagtcttgctctgtcactcagtctggaatgcagtggcatgatctcggctcactgcaacctactcctcccaggttcaagcgattctcctgcctcagcctcctgaatagctgggataacagacatctgccaccacgtccagctaatttttgtatttttttttttttagtagagatggggtttcgccatgtttgccaggcagatctagaactcctgacctcaagtgatctgcccgccttagacccccaaagtgctggaaatataggcttgagccactgagtccagaccttcctagatattttgaacagagcctgcttttctcagagaaaatatttcttcttttgtccacagcagccctgatatccatggtgaatagtgtgttagccattttctgccttgcagaactattattataatataataatatccaaagaacagtagcaatttttatatagcatttactgtatttcagataatttttaaatgcgttttacatatattaactctttatgtccttatgtaatgctctagggagggtgctataattattcccatttttcagatagaaaactgaggctaagagaagttcagttacagataccacacacaagaaagggacagcatctctggaagtctgactcctaatcatgggtcactcttgtcatcagatgccgggcaaggtgaagccctacattctacagacgtgttttcagaaagtctacaccacgtttatgcactagtattcatttatctggtagggtcctttgattttattgggtagtgctttatgggctgataaatgaggtgacattaaggatagtaacactgttttcttcccttttctgtaaaaggtgagatggttgcctatggtgttagaaaggattgcaaaagatttacttggggaaaattagcttcctctgcactcccctgctccatttctactgtaagttattatgatgaaaaaaaaaaaaaaacctgccagaacattggcttcaaggtgaaaatatttaggcaaaatattaccacagggaaagtttattttaagcatcaaggttaaaaagacacatgtgtcagatttaggattttatgcttaaagctcatgacattgccacaaagtatttggttggcaaacttttcctgcagagggtcagataataaatattgtagggtggtggaccatacggtctgtgtcacaactactcagctttgcagttgtagagaaaaagcagtcataggcaatgcaaaagcaatggaatgttgcggcattgcagtaaatgtttttaaccacagtcagcgaggctgatttggtccacaggccatggcttactgaccccctgctatcaaggaatgaccagggatttggagataggctttcaatccttccttgtcatgtgccaggtggacggccttgtggttcaaagacttctttgaaccttgcgtagtcacaatctctctagatgttaaatagggaaactgctatgccccgatgagcatggtcatgagaactgaaggagtaccagaactgaatgaatgaagtactggattcagtaaaagaaattccatgtcatccttctctgccctctccaaacccctttggttctacttttccctaccttgtaatatttttgttaacaagtggtaagagttaattaggggtccctgagatttttagggtgcttttacattttggtaaggctagtagtagaaaagtactacctaaaagagaattaactaaattccttccttccttcttccctccctccctcttccctcccttgctctctctctctttctctcatctctctttctctcttcctctctttctcgcttgcttgcttgctctgttgcccaggctggagtgcagtggtgcgatcttggctcactgcaacctctgcctcccaggtccaagcgattcgtgtgcctcagcctcccgagtagctgggactacaggtatgcacgatgcctggctaggtttttgtatttttggtagagacacagtcttgccatgttacccaggctggtctcagactcctgagctcaagcgatctgcccatctcagcctcccaaagtgctaggattaaaggtgtgagacaccatacccgggccccagaggagagctttctgagtcaccatatgtgaagtggttcttacgtaatttctacggaaaaaaaactcagccgtcgaaatacaggaaggaaaagggttaatttctttgtaacagagatagtgaataacaagcataccactgattccaccaatctaatatacatgacacaaatcactgaaagataataatcttcactgataaactgaatgagtcttcagaagcttgttcatgacagttctttagtcattgtcagtgattcgtagttgtctcataaaatgaaacctattaggtatctttgacctagttaccttttagggtcagagactttggagattttttcagattataagctacatgaagttgttacagggttgctagtttaccttcgctttgtaaacagtgatgctcctctatagggatgtgaggttgaattccgagagtcacctgcccccctgcaaaaaaaaagaccaaaaagtaaaaagcatcttccattcttcctgaagccccctctcttcatgaaatgtcctcacattgaagcctgatgaattcgttcatgttcttggctcgaaagttcttagcagcagcagcagctgaatttctgttgtctgttcttgttttccttgtttttaccattttctagatattttatggtgaactgttgttatagaaatatggaaacaagggatagtcctaatacatcctgttgcaaagaacagaaacccagtttagactcagttaagcaaaaagggaaaatttagctttaaaatattccatagattccagaggattccagaggaggaagagcggcaggaagtacgatgaagcaaagaccaggaaagggatcagcaccctggacagcatctctttcatttctctttggaaatggagcccatcagatttgcctcacccctgacttagcactttgtactaaatcccttagaaatgccttcccttaatctccacattcctgagttttttatggcaattgcattttagctcaacttctatgtcttccaaagatcttccctgttcacaacaattacatgccctggtcataaattatcttattttctttgttgcttgtttatcatatgcaccttcccacactggaatctaagcttcctgagagctaagccttatttagaacaatgcctgacacataatgggcacacaacaatatttttgcttaaacacatgtataagtaagcgaatgatcccctaactgccaatttcctaggagagagaattgaattgccccagctgggatcagtattcaaccctctttttattagttgaggcagagtgggttgagtcagatagaacagccacttctcctggctgcctgtgtctgaagggaggtgtacttgatttggggagaaaaagaagccatggtgaatcacgaaaacatattccccaatgacaagtgtatcgtgcttgtcaatttacagagggtagtgagggtaggggttgatctcaaatttgacagaagaaacagaggtaatttttttctacctgaaaatctttaccagcacttgaggccagtgggcaccatgaaagtatcctgaacgaaagtgttttatttctctattgttattaaatagtgaaaccttcgttgggttcatccaaattttagctataagagatgctttatctattttttctttactttgtcaatagttctgaataaatgtgtgtgcttaagtgtgcttgcacatgtgtgtattttttttccaggctttcagaagcctgcattaataatctcttagggtcccgaagcaggaacatgtatgagaatacagaaccagatgatatcttcaggcagaaatttaggaagagttgactcacactgaacacaagctagttcttaggcttactgtcagaacaaaattgataaagcttaggaggacatttcatctcctttcagtgtggttcagcaaggagctatttaatgcctcctattgtcaggtgtggttttaggtaccattcgtatcaggtctctgccctcatggaaccaccattctaattgagggagtagtttaaaggggatagatgggaattaataaaccaataaagagaggctaaaatttcagactgcaatgatgacgtcattaaagaactgaaataggatgatgtgaactgaaatgatgaggggcgatgcagatggctggaggtggcctaaagcccaggaaagtggtggtggagaagaaggcaggattggtgagaagagcctggcagcacaaagatgtgtgtaaaatcactgacaggaaagggctttgtgtatttgaagatcataaaaagagtagcacagggctggaattagctccgtgaacaagtggagagaaggaagtggagaggcagatcaaggaggacttctttgcttatagcaagggggttgaattttagttttaggacaataggaagctgtggaatgaccttagagggaagacatcatccaaatgacagtgtactctgttccttagctgaagagagaaaaaaacagatgcaagtgcaagaggttttagtagaagtctaggggatacatgatggtggttatagcatatccacaaacacctcatgacccagggtgtctgttcatctgcattgcatgcatgtttttacctcctctgacatagttatttgcagccctgtctcatggtcaaaagttagccaagtgattgaagtatgacatattggctgtgcctttgtgacaatccttagtcttgtctgtttagcaaacagtatggcaagttggaattctagagcagtcacagtataccatgcttgatcacatgggtatacctaaacagttacaaacccccaaacctgattatgagctcttgtgaaacttctctaaaaatttggggcaatgtggagttacaggtagaacttgagcttttcaagtcagaaaccttagttctgaatgtttgtgcctctatgtatcaactcagaactttagaggagatccttgccctttaggtgtgtttgtgtgttgaagtgttactaacactattaataatgtttacacatgggtaatattaaccataataatgcttacttggtgcccaaagtacgtttgatactttacatatgttacctctctcaagcattacagtaaacatacaatatgcataggatagccccactttgccaataaggaaattgatccttagattaaataacatacttgaaattgtgcagtaagtacatggaggaatgtccatacaatatatctatttaaaccacctaacagtggggtattatggaagagcatatgggagcactttgcaaagtgtcaaccgcagaataagtgcttgataaatttcacattatacctctctctctctctctgcagatttcagtcacttatgaccacagaattaattctaaagaaagcaaattgaaggaggtgtttgcacgtatttttttttccctaatgattctactgtaccctggagcattttcacggtttgtgtttaatcacagaatctcagccatgatgtttctgacaggcaatttccttaatgcatttgacagagatggattacatggagggccattggacgccatggttttgtctgcaaatggtaagactagattagagctatctgggtctagtgcctccagtgatattgcatcctaataattcttatgataacatggatcacctttgtggacacacacattcttggccagatgggatacagtggttttcaagaaaccctgccacttttattacactttgagaaacatctggactaatatttgtgtgtcagaatcataaatcaatttagtttgcggagataggcctagttatgcggtttatcttcaaaggcactcttttttgctaccactgaaagtggtaaatgaggcacataaatgtcgagatattgaattccttctgaaactgtaaagtctttacactggcatatgaagatctgagcatcagtcagactctcaggtacttgatgaacaagagtgatttggattccatggcattttatccctagataacaacaaacccaacccattcttgagcaatgatacaattcccactggtgactcacttcctgaccctttctccccgtcctctgaagtatgtctcagccattagttcctatgtttattggcgcactttagtatagatcaaaggcacacagacaggttcagcgatatttgctaaccctgggaaacatgaatgctactattttgaaggatattctttatttgtcactggtatttaattgcacagatatgtacaaccattgtaaaggagattcctagatatcatgatacttatctctaatgacataaatatgtatataaatatacataaatataaatgtgtatataaatatttatataaacataaacatatttatataaacataaacatatttatataaacataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataaacataaacatatttatataaatataagcataaacatatttatataaatataagcataaacatatttatataaatataagcataaacatatttatataaatataagcttaaacatatttatataaatataagcttaaacatatttatataaatataagcataaacatatttatataaatataatatttatatacacatttatatttatgtatatttatatacatacttacgtctttaaatataagtttcatggtatctaggaatctttgtgtccttagagattctatatgaagcaatgacattattataactaacagcattaacttaaatctatcctgccatcaagtatccagtctgtattaaaatgtattcagtgttttgaacaatattctttatgacttatttttaaaatatagctctctaggccaggcacagtggctcacacttgtaatttcagcactttgggaaactgaggcaggcaaattgcttgagactgggagtttgagaccagcctgggcaacatgaggaaaccccacctccacaaaaaaaaaaaaaaaaaaaaaaaattcagaaattagctggacatggtgatgtggtcccagctacttgggaggttgaggtaggaggaccactttagcctcatgaggtcagggctgcagtgagccatgatggtgccactgcactccagcttgggcgatggagtgatactctgtctcaaaaaataaataaaaaaataaataaaatgtagctctctagtcattttgaagtactgaaatcatatgtaagaagagtaggaacaagtagcataacacaggatataaataattaaagtaattttttcttaaagtgcatctgtccttccttaatccttctgagagattatcgatcacttaaaaaattgtgtgaagtcttacaaagaagtatatacataatatgatactataagaaagcccttggccaggcacggtggctcacgcctgtaatcccagcactttgagaggccaaggcgggctaatcacgagatcaggagatcgagaccatcctggctaacacagtgaaaccccatctctactaaaaatacaaaaaattagccaggcgtggtggcgggcgcctgtagtcccacctactcgggaggttgaggcaggagaatggtgtgaacccgggaggcagagcttgcagtgagccgagatcgtgccactgcagtccagcctgggcaacagaatgagactctgtctcacaaaaaaaaaaaaaaaaaaaaaaaaaaaaaaaaaaaggaaaagaaaagaagcgcttttaaaatcttagaaacaaaaatcgctctctgtaaaataatattcatcagcatttttcttaatggtgagaaattagaaacaacctaaatttctgacatagaaaattgcctaatttatggcggtcatattggaaaatgttcaccatgtattgtcaagtgaacaaagtggtttccatgaccgcatgggtcaaatcacagcactttaagaatcaactcacagagagaacaaatctcgagaatgtatctgactgtgtgctagccatagttatctctagatagtgagattataggccatttttatttcattttaacttttctctgtttctcacattttttgcatgcaatgtggaatatttggtaattgtgtttaacaattttggaagatcagccaactcagcaagaggtgtattatctaactggaaagaaaaccagaggtataaatacgatggaatgaaacactccctgagcctgtgtgcattctgcataggcttcttgaaatagtccatggctgcagagatggaaaagttaacataagtgctttaagttaaaatgaagaaactgttgtacatcttcctatatttcctttggctatctaagtcctgcattagaatgttctgatattttctgaatggggttttatgaaaaacctagagttaaaatttgcattgcagttagtttcaaaatgctatttagaggaagcttttagctgcatgttacagaggtctaatatggaccctaactgaagttatgcagaaaggaaatgttttgctgtgtgtgtgggtgtctgcaccttttctccccatcacccacctcgttccctgaatgctattttatactctaagcaattaagagtggtttatgctgcagacttttccaataagcattgactcattataccagtccagtatcattatcctgagttgaacatgtcctgcagcaggtttcatttattctgctgcagtcttcatttctaccatatatttggagattcagatacagatttgccttgtaattgtcaaaagtaagaccgcaagagctggtatagggcatgctacgaaggaaccaaagaatgacattgagttggctgttaaaaatgcaaattttggagttggaaaggacatcaagaaaaaggtttaaggaacagaggatacagacagctaaggattggggaaagttctttgacaccatgaagactataattgcagcctgggtagcttgataaaccactcaaggaagggttggttcaagaacatcaggctagaggcaagtcaagaccttaaggcatttggaggtgatacggagtgatttctcgaaaaggaattctcaatggatagaatcctcataggaagacctacactgattcaggtaataaggagtgatttctagaaaggaatcctcagggctgggcacggtggctcatgcctgtaatcccagcactttgggaggccgacgtaggtagatcatgaggtcaggcgatcgagaccatcctggctaacacagtgaaaccccatctctactaaaaatacaaaaaaattagccgggcgtggtggcgggcgcctgaagtcacagctactcaggaggctgaggcaggagaatggtgtgaacccgggaggtggagcttgcagtgagctgagatcgcgccactgcactccagcctgggcgacagagcgagactccctctcaaaaaaaaaaaaaaaaaaaaaaaggaatcctcaatggatagaatcctcatagggagacccacactgattcaggtattctctccagtttagaatacattgcccccactccaaaacactatgtcccccaaaacacacacacacacacacacacacacacacacatacacacacaaaatagagcacataagccactctatgcagcataattatctgtatctcattttcccttcatttgtaaactagcctaccactgggaaaaaggtaccataggttataaattactgatggggtctaggtcagcagttcccgtggttcccacagacacctgcaggcaatcccttctataactttccctatgcatccagcaagtaagttttctttctttcctccagctttctggaagaatctgttcaccattgtacatcttgatcgcctttatgtctgcaataggcccaactcacatccataagaaaaacagatcattctcctaattgaaatagaagagcttgggcaagacatcaattagtgatgcaaatgtagagttcttcattgagcaatgacaaaatcccaagacttattagaagaccaataagaaatggaaaaccatgatttactggcagggctagcacagttaaatttaaaataaaaatcttggccgggcacagtggctcactcctgtaatcccagaactttgggaggccaaggcgggcagattgttctaggtcaggagttcgagaccagccttgccaacatggtgaaaccccgtctctactaaaaatacagaaattacccaggcatggtggcacacctgtaatcccagcgactcgggaggctgaggcaggagaatcacttgaacgcaggaggcggaggttgcagtgagctgagatcacaccaccgtactccagcctgggtgacagagactccgcctcaaacataaataaaataaaaataatataaaataaaaaataaaacttccctcattgtttttgttgtcagcctttacaagcattgatgcttccaactcttccacaaattcccaacaggtatttttacatatcatccaggcattttttttttctttcctgagtgatactctgatctctatctgatgagctggagagtgacctaagttagaagggaaagtagaggaggttgctaagagggtaggtgtagtactgaggtatagagggttggtagagtggtattgctactcagaaaccagtaccacatgaaatcagaaattcagctccccagaaatcagtgccattccatcaacaaacagatccactgtgttctcctggccttgcatggttctaggtttgtagagcaagtttttaattcgggtttatggcattgctcatattcgccatttcagtcatttttggtaacagttacgttgagcttatctgcatagacgcacatgatgaacaaggattgactattcttcagaggatgttaactgtttagagaatcatgaaggaagcatattttacaaagaccttttttttttcctggacttctccctaatcatctcaatcagaaccttgaaaaaggggcccaggaatgcgaagtgtatgcctgtctcccacccccacatagtgtctagatgatcaatcctattcggggaccccttggatgtgagtgtgatatcattagaacataatgaaactgtgattcctaacccagaggaaaatccatcttaattcttcaccatcatactttatagttagtgctctcttccaaaggaaacccctttcaacccctctcattttttaatatggaactttgtcttaataatggatttcttcagtctttaatatttgatgggagaagtaattccagtcatggcacatcagaaagttgctttttttcctctttctaataagacgtataatccgttgctgacaaaaaaagaaaaaaaaaaaaacagcacattgctacaatatttcctggatgctttacaatacactgtgacaaatggcgcctcatgttgtacaattgtcctcatggcttgtaacacatcatttaatgaattgatcacagtggaatgtaaagatgaagcagcatttattttgtatgttatattgcatataatttttagagttgacatttataaccatggaagctgttattttacatatcatcttcaaaccatatcagccttaaacacatttaaatttaataagcaagtagattagatttgcttttaagctaggcatatcattacagtgcgtgtttccgtcagaagggcatgctcacgattaaatactgtcttcagttgttttaaagaaacaaaaattttaaagaagggggttagagcgaaagctgaaataattgagtatgaagccctaagaattctctgtggtggacaactgtaagcatagccttctaaccattgaggcgaaagagtccgtttggttttattaaccatcaccaggcaactttgaggcagaatgtaagccttgggaatgaaatgcaaattctataataggaacatcattgtgataataatttattaaatttcctgagccgtctccctctaaggagggctgcacaaacggccctggtgattaatgttcaacatcgtttaacattttattagagggaaacagtttttaatctattgatgccctgtctgtagaattctacgagctgttttcaaaaccagagaaagggggataaaaaaagaagcaaaaaataattggtgggggaagggggtaggtagtagaaggaattcgcaatagcggttctagttctgatgccagatttctcagaatctcctgtgttttactggcattttattgttttagcctcttggtagcctgttgatgttttgtgcaaggagagagagtttccttgtgaatctgacgttagggaaaatgtcatattcagtggagaggttccatctaagagagttggggtgagaaattggctgaactgggtgcttctctgaatcctagtagtgtttgcttaggagctttagactcaaatgcctatagaggccagaagggtcccttcaatggagattataatacgtggaatgtagtaaagtacttagcaagcactcttcactttgaataaatattgaggtactgaagcatcaactgtgagaagaccaaagacaaataacagcaaaatactatgtgaaatcatagaggagatccagacacacgaaaagggggccaaatggaaaaactaatgcaatagacagtttagatcatagtattgtttcgacgtcaatttcctggtacccatcattgtattatgattaagtatgatgttaaacattaggagtgactgggtgagagacccaggagtgctctatattatttttgcaatctttctgtgagtctaaaagcatttcaaaataaatacaacatttttaaaaagtaaaattggaacatacaaaacacactaatacggaagatgaagtccgaggatcatgtgcttacaacattgttacttcgccagtctcacaccctcttctgagaacaatgtaaaaagcagagagaaagatctcttcccctcctctttgtgtcgacagacatctttgggttggacaaggtggtaggcaaaataatgcccttgccttacctatggccatgtcttaatctctggaacctgtgagcatgttgggttacactgcaaaggaaaattaagattacatgtagagttaggcttgctaatcggttggccttgagataggcgcattatcctggattatctggatggatccaataggattacatagggttgttataagtgaagagggaggcagaagagagagagtatcagagcagctcttcctgaaaagaactcaacacattattgctgtctgtaagatggaaggaagccatgagccaaaagcagcaggctgccgctagagtctagaaaaggcaagaactcagattcttccctagaacctccagaaaagaacatgccccacaaactccttaattgtagctggatgagacctgcatcagatttctgaactacagaactataagatgggttgtttgtgttgtttaaagccatcatgtttgaggtctttgttacagcagcagtatcaagctaatacaggcaagtaatcaatataactgcaaatgcttttatggtccttacacgtgccagatgctcttatgagcattttacatgcattaccgtccttgatccaatgaggcaggtactacattgtgtattctgctttataactgaggatactgcaacagtgtgatgttaacttgctcgctgtcacagagctggtatgtgacaaagcagatgcttagtcagaaatacagagcccatgctctgcaccagcaaccatggtagacagctcagaatattagtactagactctagcacaacaggtcctagaagatattatggtaatgtatttacgtaactcaaaatgatcagacatgtcacaagaatgaaagaatgacagactaaaatcttcttggagagttgactggaaggataagatattctagtagcagttgaaaatatagtagcatctatctctagctatcttttttttttttaaggattggctaaaaatagtctttcccaagtataagccgtatcatattattatggatttagacgggtatacatgatgctattaaataacattgaatcaattattgggagaaggagttattctctttccatttctctttccattaccctattcgtgtcaatgagaaagtctttatttggtactagagtgtcttaaacatctctctaatactttgtgatctctgtttttagtaataaaatggaagcctccggctcagtgtctacaggtaatggttgttagattttaataacttgtgattgcactgtatttattttatggctaccttttattcagaataagtgatattgttattttatcatttacattactgatatccagttgccttttaaaaataatgcatttcaatttaaacaaagcacatcaatgtaaaaagatactaagcagctgacaatttatgattatggtacaggatgaccgtctagtgactttggcagtggaacggctagagtttgggaaaatctagctctttggggctaaagatttcaaaatgtacatttaaattaccaaacagatactcattactaaaactcaatgcctgaaaccatctttgaatccattctgttttctacccctttcccagaaacacttcgttttattacatttagaaagtggtgaatttagcccaggcacagtggctcatgtctgtaatcccagcaattttagaggttgaggtgggtggattgcctgagccctggagtgcaagaccagcctggggaatatagtcaaacctcatctctacaaaaactacaaaaattagctggacgtggtggtgcatgcctgtggttctcgccactagggaggctgaggtgggaggattgcttaagcctgggaggcagaggttgctgtgagccgagattgtgccactgcactccagcttgggctacaaaatgagaccctgtttcacaaaaaaaaaaaaaaagtgaagaattcaaagacagctgaataacacctttcaatattttatcgaggttaataaaattgattggttcttaattagttgtttattgttcttctaattctagcaacaaaactttaaaaaattatactctctgaattttaataaagagctcttcagtctatcaacacccttaagtctgtcaacttcaccatgttttgtgcctcatattgcatttcttgttggaccagccatattaggagttggggtggactctgttcatggactgagtttcccagaatagccttatatttggtgataatgtctctggctgagcctcattctcttaaattaatttcatcacacaggcttgcaaaataaggcttcttgtgaaagtcttggttgcagtgtcttttctagccagtttcaccaatgacctggtgtgcaaatttgtccactgtaagagtatcaaagacatattgagaggaggtgatcattattacacgacctgggcaggtggctgtcctctaatattggcaaggcaaaacagaacaactgacccaacagcacagatttgaaagactgtttgaggacctacgatgcttgctcttgctctctttatttatgtatttatttatttgtttgtttatttattgagacagagtccaactctcttgcccaggctggagtgcagtggtgggatctcaactcactgcaacctccacctcccaggttcaagcgatagcctcagcctcccgagtagctggaactacaggcctgcaccaccacacttggctaatttttgtatttttagtagaaacgggatttcaccgtgttggccagactggtgttcaactcctgacctcaggtaatctgcctgcctctgcctcccaaagtgctggggttacaggcatgaaccactgtgcccagctcgatgctcataattttagaaaggtgcctggtttatatttcttataaatgtgtcactgaataaaggttagcccacgtgatatgattttttctttcattctctactgccacactgctatttgtggcaagatctaaggagtttcttccaggctgtcaccgtctgaaaaaaaaaatgtgagtatcatatttcccagcctcccatagggagttttaattattattattattgttattattattgtttgctcttttctcttcatcatcctactcctcctcatttttctaaaggaagtaaaggaacaggcttggcccaataattttgaagtataaataatcagtatgttccatagtcagaatggtaataatgattccgttaactcagtttatttagtgcttgtgtgcatggtgaatgtaatgttcttgttatcgactgtgttatcttcactctcccctttcatcctgaagatgtctcagggaatttctccttcaacttttcctacccaccctgcttcactccccctctccccagccccatttgccactgacttgcttagcagcacaaaatcaagaaacatctttcattcagaccattgccaacactgatagtgtaggtacccaaaggtccaatggcttcccaaacatttaagaggcgtctacaatgtgcaggttagtgcaaccggctctttaaatgcacaaacccacttcaccctgacaacaatcctgagccatgaatatttttattcgcattttttagaggaaaccagggtcaatgccttcaaagaacttgtagttaggcaaaggagacaggcatgtgtgtataactataagtaaaatgcaaaggcatctgtgtacagagggtcaggagtcatgctgcaaagtgagtttttggaaggtttgcggaaagaagggaagcctgggcaggcttttgaggatgggtgggaattttttcacacagatgatttatggaagggtgtttcaagcaaagaggacagcatgtgcaaagggaaaaggaaatggaattctgagccaaaggtaaatatgcacagctaaatataattagagtggtgtgcagaggggaagttgggttatctgaaatatataaatccagtggtctaatctttgcacgcaagtctgggtaattttaaggagagtttaaaagactccatttcgaaggtgcacaccatagccatctttcagccagttgctccttgtgtgctagacacctgaacacatgtattactcctgttccatctctcccagttattccttctctacccatctccaatctgtccttcattctagcgttctctggtttctccaggctgttgaaactaagtacagatgtggctcttccaagcctccttcatagccgttgtctttagggatgaagaaaatgaataaggaaaactgtggctctgagcagctattgcttcatgtcgtggttgaagcaggaagcgactgagcttgctatcgattttaactcctgatcttgggaatcccagagcttctttctgtttctggagtgatgtttttctttgaagctaagttaaaaggtagtcatggggagagagcctaaaaacctgtgagtggaaaaaaaaaaaaaaaaaaaaaacatcaagctgtgatactgcagaattatcacagatagtgtaaaactgtgtggccatgccttaaaaaaagttaaacataaaattaccacattaccaagcaattccacttggaagtttatttgcagtaacattgaaaacaagtactcaaacaaaaatgtgtacagaaatgttcatcacagcattatccacaatagctaaaaggtggaaacaactcaactgtccatcaccaggtgtgtggataaactaaatgtggtatatccctgtagtagaacgttattcaacagtaaaaataagtggagtactgatacatgctacaatgtagatgagagcattatgctaagggaaggaaccagacacaaaaggtcacatgttattccatttccgtgaaatatccagaataggaaaattcacagagacagaaaacagaatgggggttgccaagggagcaggaattgggagtgtaactgaaaaatgatcatgtgttttctcttttttcccccgttccactcagctcataccttgtggttttctttctttctttttttttttttttttttttttttgagacggagtcttgctctgtcgcccaggctggaatgccgtggagcgatctcggctcactgcaagctccacctcctgggttcacgccattctcctgcctcagcctcccaagtagctgggactacaggcacccgccaccacagctggctaatcttttgtatttttagtagagacggggtttcaccgtgttagccaggatgttttcaatctcctaacgtcgtgatctgcctgccttggactcccaaagtcctgggattacaggcgtaagccaccgcacatggccaatatacccggtggttttcttctggggtgatgaaaatgttttgaaactagacagagggtggtagttgtgcaacattgtgaatgtactaaatgctactcatttgtacacttaaaaatagttaattttatgttatatgaattccacctccattgcaaaagagataaaatcaaaaacaggaagacagagtgttttagtttgttttgtgtttttgtaacagaatatctaagactgggtaacttaaaagcaatcaaagtgtatttggctcatgggtttggaggctggaaagtccaagagcatgacactgcatatcacatgggctttcctgctcctccatcacatggtggaagggcaagagggaagaatagatgaactcacttttataacaatccactcacatgataactaactcactgcagcagtaatgactttattcgtgaaagtggagttctcgtaatctaatcacctcttactgggcctcacctcccaacactgttgcaatggatattaaatttctgacacatggactttgggggacacattgaaaccatagcacactatcagaggcaaaatatagtgttggttcccaggcaatgagttggctgccttgttcacagtttgctcagtatgaaccatgcttgcaggagaacccctgaaatcaacccttagagaaatggtgtccatctgggaaagtagaaaaggagacagctccaagcaccaggactgagtttcagttccaagggacaagggaagtaagaatatcatcaccacaggtccgtcctcctccccagaggaagaacacaggctgcagaggtgacagctcacaatgttagggactgttgatgagaaaattggaaatggatggatttttatggcaatgcatttttaactgcacttcagcatagagggggacattttaaggagctaagagcttaaaccagacaagatttccttcagtgtgataataaatacaccaaagtgcccttttatgtttaataattcaggatccactgagtgtttaaagggttttttttctgttttatcatttgaaaaatcgaatggtaatcatttaaaaagtagtaggtgagaaatgttttccaaataggccctgaatcatgcacttcaaaatgtctttggaaatgaatgactgagtgtttcaggcagcgtacgcctgaaggtttggaagttttaacacagccaaacacctgtcattgctgtgtatactcatgttcagaggaatggtatctacttccatacacagaatcagccaataatctgatcagggctgggatgaaattagacaaaaaggctgggcagtgcagtagctcacgcctgtaatcccagcactttggcaggctgaggcagaccaatcatttgaggtcaggagttcaagatctgcctttgccaacgtggtgaaaccccgtctttactaaaatacaaagattagctgggcatggtggcaggcacctttaatcccagtttgctcaggaggctgagacccaagaattgcttgaacccaggaggtggaggttgtagtgagctcagatctcataactatactccagcctgggcaacagagcaagactctatctcaaaaaaacaaaacaaaacaacaacaacaacaacaacaaagaaattagacaaaagaacaaacaacgtgttggggaacacttttgtaatctcattcttgaatgtgctcagaatgtggatagtcacaatcatagagccagatttctgggaaattctagagtgaaatctaaaagtcagatactagtcataatacataatagtgtcagggacatgaacacatagcaccaacaaaactggtttgaattgttctgggctacaaattgggcctccacctggaatataatgcaaaatcctaggaagtagtgacttttagaaaggaaactcgactgtccttgtagatggtaaggatgatactgtggttctgagatttaaagcaggtaggttttcccagggagtggagtggagaagtgaataacttaatggtgacactaagttggcctgtcttatggaagagcctgaatgtgacaggaagcacgcatgtgcatcgttaagtatcatcttagaaaatataacccacaactgtgctctctccatattcagcaaatgtttattgcacctctatttatggtgtgcctgtcagacactgcagtaggcactaaggatgatgttgcaatataccccacagacaacatcactgcttgcatggagctcatattttctgctcgaggaaaaacattcaagaaggagttgtgacagaaactgccagctgtctacccagtatccctttatgccttcttttaaaggaatagagtgcttggaaatagttcacttagtcagagtcagtatgccccaaattaaaggataataatgctgtgttcctcggcttagcagagagggatccccattaagatggcagtgaaaattattagacatgcatcctgggaaaagcctctaatagggactaactcatcgtgatgaaaacaccataggccctttcatgctttctccgcgctgttgtatgacattatgtgactttgaggcaacttcgttggtggaatctatgttctaaggataatggaataaaaaagtgaatgaggcaagaaggtttaagatggaatatgtagccctgaacttcttgtatgggagagaaaaattaatctatattttgtttaagccaccattatttggggactctctaaatagcaaccaaattgaattttatgagatcagtgtgggaatcacaaatataaatttatttctgaatgtaaaaattgctctgcaggcaacaaagctggaagatatgagagagaggaattggggcaagggttggagagaaagacctctctgaggttaaaacaaagtctggtatatgcacctctcagggagaaacatcccaaaccaaaggaatgccagataccaaagtgagcaacacagcatagcagagaaacaacggagagccaggtagtagaagaggtgaagtcaccagctgaggtgaaggaaacaggagagatcaagtcctgtgtctcctattgtgggctatgttaagaagtggggattctattctggctgaggcaggaggtccttagtttgatctaggcaagagaatgccacgatctgattcttttttttttttttcttttcttttttttgagacagttttgctcttgtcgcccaggctggagtgcaatggcacaatctgggctcactgcaacctctgccccactgggttcaaacgattttcctgcctcagcctcccaagtggctgggattacaggtgtccaacaccacgcctggctaatttttagtatttttagcagagatatggtttcaccttgttggctaggctggtcttgaatccagacctcaggtggtccacccacctcagcctcccaaagtactgggactacaggcaagagccaccatgcccggccgatctgattcttatttacaaagcttacccaggctggtagagaatgggcacggcaagcgtgaagttaggaagctcatttgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttctttttttttgagaccgagtctcactgtcaccctggctggagtgccaggctaattttgtttttatatttttagtagagatgggatttcaccgtgtgagccaggatggtctggatctcctgacctcgtgatccgcctgcctcggcctcccaaagtgctgggattacaggcgtgagccactgcacccagccaaagaaatgtttttacactcatattcataacagctaaaatatgggactaatacaagtgtttatcaatgatgaacagataagcaaaatgtgatactcacacacgcacaatggaatattattcaaccttagaagggaagaaaattctgacgcatgcttcacaaatgagccctgaggacattattctaagtaaaataagccagtcacaaaaacacacgcactgtataattccactcacatgaagtttgtagtgaaaagcagagagtcaaggagaatggtggtggctggtggagaggaaggtaggggaaaggacagttattgtttaatgggtacacagtttcagtattacaagacaaaaagagttctggaggttatggtggtgatggttgcataacaatataaatatacttaatgctactgaattgtatgcttaaaatggttaagatagtaacttttatgttgtatttgtgttaccactgtgaggaattggaaaattatagaggtgggccgtgcccaggattgcagtgagttttcagctggcacagctttgtccatgcttctcacagctcagatagggtccctctatgtgtgagccctagtccacattttggttaatacatggtctcttccatttctctgtttccctttgcaaatatctgcttggttagtgactctttctcgaaatctcctcataacccaccaagcaaaggcaatcttgtgccttcccagcaagtgattgtcttaccggccacggatttaaccagaaatctaagtttgtccagagagccagtcctcagaaggggctgaagtcagaactagtcaagaaggacaggtgcacatttacatatgatttgcatctgctttacatagggctgtacaagctgtgctgtgttctcaaacatcacttacgttatattttaagactgtcgcaatctttaactaacatttcgatctgcagccagggtgcccctgacttctccagatttccatatttaaactggctacaactctaatccatgggaggtgggaaatccacggcacccacagggtatctgcagatacctgccagaaggctttactttctcagagtaaccattcattccaatgatccattctcaatgaaccatctcatcctacctctcatctcttgcctctatctcaggcccaccctaaacttgcagcatcactcaaggccattgtgtgtatcccattttaatctgagggaggacaggattgcaaacactttaatattagcattcccatatttataagttcctggtcaggtgtaatggcatatacctgaaatcccagtactttgagaggctgaagtgggaggatcacttgagcccaggagtttgagaccagcctaagcaacatagtaagacattgtctctataaaaattataatagtaaattagccaggcatggtgatatgcacctgtagtcccagttacgcaggaagctgaggatggagaatcacttgagcctgggaggtcaaggctgtagtgagctatgatcgtgccattggacttcagcctgggcaacagaacaagactgtgtcttaagaaaataaaaatgaaaaagttcctcactgttctaagacatcagggattattcactggcatttttccttgtatttttagagcgaggcttccttcatctccttttctccccctctccccaatcctttctcttttccttcttttctcccttaatgcaaactgattggtaactcctcattttcccctccgcacagtttctggcattcgccattctactccttggttttctgttcttgactgttttggatatattcatctttctatgtctcttgcactgtctgggactatgcacttcaacttgaaattccttgtcttttttgtcccaaagaatattgtgactttctctttatcctacactctcttttccatgtgtaacaaggggaggtgggagtatgatgccactcctctatgagatagaggtagaagttacatgtggaatatttacttccccttttatctgattttctcctcccacctcccttcactgatagtaagatagaggctgagagaccaagaaaaatagtgagagagatgaggcttgctcgatgaatattttggaaaactccagttgagtgaaaatgtatggaaatgggcggggcgtggcggctcacacctgtaatcccagtgcttagggaggctgaggcaggcagatcacttgatgtcaggagttcaagaccagtctggccaacatggtgaaacctcatttctactaaaaatacaaaaattagctgggtgtggtggtgctctcctgtaatcccagctactcgggaggctaaggcaggagaatggcttgaacccaggaggtggaggttgaagtgagatcatgccattgcactccagcctgggtgatagagtgagactctgtctcaggaaaaaaaaaaaaagaaaaagaaaaaaaagaaaacttacggaaataaacatgaacctttcagtagaatgttcctatccaccctgttttcacttctacaatctgtgtttacaaaatacgatacattttagaaaccaaaattccatgccttcttggtcattaataacattgacgtaaacttggtccaccatctgcagtctttggtgatgggcagaaagaaaacgaagtccctgagtctttgaaaagggcaaaagtgagtgcagggactgcagtgattatctgtatgaggtgaattgaaaccttaccactgagagaactgtgtgtagtaattactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagttttacttagactgacactaggaactcagtaaaatgttaagcaggtttagggaagtgcttacctgatagtctaatttagaaacataatcttgtacacacagtaatatttattattggagtaagtcagtagaaacagactcataacctttctagggagacccagtaggtaaagtggatttaccagacagtaacatcttagtcttttgtgtttgtatggcaagtatctaagttaataatgggaagtaggtgaaagttttcaggttgtgtaccatgcaattggtttgactttgccttgccaagtaagcctaacataccccttataaatacactacatgcatttttagcaattagaatatttacttactgaaatatatatatacatatatgtattatatttccttattaatatatataatatgcgtgtgtgcatatatatatgcacacacacacacatatattttagaaagacacttgcaagctctcaaaaatgagttgctgcaataccattccctctgccaatcatatgggttaaggctgattttattgccagtcatatcgtactcaagttgaagtgctaagaatgctgtcttatccctcagctagattagttttaaaaggtgatcctgaagtcctgacaagcacagagtgaggatttacgaagtgacaaacagatgccgacgacatttactgtgagatttctcatagctgaattcccagtcctggccaaggagaaatatgcaacaggggagagtgaaaggggcattttaagttgggatttataaacaatcaattctcttcttatcagaaaaaaaaaatggagaggctggagaaaccgtcttaacttgaaacagtagtttattgcttcttacagcatggtctgtttctgttctgtgtggtagtcccacttacagtgcacagagcttcatggccttttgcagccaatttagccccttgcagctcagtgcaatgccatgcttcatcctggcaacttcaagggctttatggaaataccctacagatgtgtaggtgcttttgtacagttggtaactgaggcttcaaatcaccccatccatcttcatggcatttcttagctgatcagcaagaggtgtacgctgtattttcttttatagcatcttcattacctttgtgtcttccgtagctgctcatttttatgtatatggcatcattggccgggcgttatgggggttcctctggtcacgttccggcccttcattctgctagcttcaggttggtgagtcatgcatgtttctgaccagatggaacatgatttttcttatttctccactgtcccttccaagaatctttatttctctctccgttaggttcacatgaatggtagagagaggaactcaacagcacaaaatagtcaaaacataacattttattaaaaccacatccagtgcaacccccggactggcccctagcacagtgcctgctacataatagatgatccagtgaatattgacagaatgaagacgtgattggattaacgactgatcttgccacaaaaaataatgacatggaaactatgacagcaaaacagtgctccttgctgagaacagtctctgcaacctaaagaaggatggagcggaagaaatgttttatctttgtttaaaagaatgcaacaactgtggagctacctagggttctctgtaaggcagttgcctccaacacagccagggttaatttgcctgttgcacccagttcatgtagcttctcctagaatgtgcagcaatagaacgagcaggccaccatctatcaccagagaatatcttacctttattcaggagagagagctaaggagaagataaatggtgacagtgagagttgaactccacagggtgcatcctctccttcctctcaatcttagtcctggggaagcttctcagttacctttattgtgagcctcctgtaagtggggtttcttttttccatcactcactgaaaccggcgcatggtatcttctctggaaaactaggactttaggcaacatcaatcctgcaacagggaagcaagagcaactttggtggttacaggaaaagctggagatggctgtttatgtatccctggagtttggtttttggaggcaggtatcttacttgggctgaggtatgaaactgtagccaattatgtcaccatctataatcggccagattgtccctccaccaattcatatgttgaaatcctggctccctttgcctcacaatgtgactgtatttggagacagtttgtcttagttcacttgtgtttcagtaagggagtagctaacgctggggaatttataaagaaaagaggggtgttttggcttatggttctgcaggctgtgtaagaagcaggcaccagcatctgcttccggtgaggacttcatgctgcttccactcgtggcagaaagagaaagggagctggtatgtgcagagatacatagtgggaggggaagcaagagatagtggggaggagccaggctctttttcacaacctgttctctgctgggtgcagtggctcatacctgtaaccccagcaatttgggaggctgtggtgggaagtttgcttcagggtaagagtttcagagcaacctgggcaacatagcaagaccgtatctcaacaaaaaattaaaaagattagctgggcatgatggcatatacctgtagtcccaactaatagagaggctgaagcaagaagattatttgagtccaggtatttgaggctacagtgagctgtgattgcagcacttgcaatccagcctgggtgaagagtgagattctgtgtctgtaagcaaacagataaacagacaaaaagcccaccagttctcctaaggactaagagagcaagaattcactcaccctctattcccttcctggcgggcattaatctattcatgagggacccatctactcttcacttcatcttccctctatgcatgtctgtgtccaaaatttccttttcagctgggcacagtggcttatgcccataatcccagcactttgggaggccgaggtggtcagatcacctgaggtcaggagttcaagagcagcctggccaacgtggtgaaactctgtctctaccaaaaatacaaaataataataataataataataataataataataataataataattgcagggtgtggcagtgcatgcatgtaatgccagctacttgggagactgaggcaggagaatcacttgaacccaagaggcagaggttgcagtgagctgatatcgtgccattgcattccagcgtaggcgacaagagcgaaactctgtttcaaataaataaataaataacaagatctccttttcttataaggacaccagttagattagattagagcccaccctagtgacctcattttaacttacttacctttttaaaagcccctgctatcatttggataataacctcaaggcctttgcacttgcagttggctcctgccagcttattacatggctggctcttgcccttccttctgctctcagtgcaaacattacctcctcaaagaggccaaccctcaccttctcatcaaaaatggctcctcttacccattgtaaccactctattaaatttttcctttttgagcacttaagtcgcatttaaaaaaatttttaatccgtatttggtttgctggttccctatatgcctcccttcactgagtgtaacctttgtgggggcaggagtcttgtctgagtcatcattgcccaggggcgttctgttgtgttcagccaaatgttgaatgaatggatgatgcaatagatgaatgagacaagagtctctccagggaagctgaagtggcacacacactctcaaggtcttgaaaatgcctgacccctagtgcaggggttccatgatgcaccatagagttgatggtaggcaggcaaaatgaaagcttttaagccccattgattcacctgtgcttattaaactgccttgcctctaaaaatgatcattctccagtgaaaaccagggatagcgacgctcagtgcagatttcccaaaggaagaaaatccaatgaagtgcatctttgcagtgtgtgcattgcttgtcaacctgccctgcaattgtgtgtattcaataagggtgataatgatgatgacaatgattttatcagtcaagatcccacacaagaaacacaaccaataggatacttctataggttaagagatttattgcaagggagtacttataggattgcgaggctgactaagcaattcagaaatccatgggccaggccatcaggaagagtatgttggcaactcttgggcaggagctgacagcgtggaccacactgtggtcctcaaggatcacatggaccacggtgtggtccttcctcacagttttgctcttaaggcctttttccaattgcactacactcaccaagatttcttaagacaatctactttacttaaagacaatcaatgttaggtgttattcatatctataaaatgccttcacagcaatacctaaattaacattttatggaataaacggatactgtattctaaccaggttgacacttaagactgaccgtcatactgatgctaatgttgatgatgatgacaactgctactctgtattttgctcttagtaggtgtcaggcatgctgttaaagttcttacatgtgttttctaatttacaacattgttgctccaattatcattctcatagtatcaataagggggttcagggaggttaaatgacatgtccaaggtcacacagggctgaaaagtacatctgtgtgtgagcaagtctagagatccaatgtacagtatgatgactctaagaaataataatgtattgaatactggtaatttgccaaaagggtagattctaggtactctcactataaaagaaaaaaaaatttcaagaatataaaaatagaaaggagggaagaaaggaaactaattttatgagatgatgagtgtgttaaattgcttgactacataatcacttcactctgtatgtggaagtcaagataagtatgtcaaagtattatgttgtataccttagatacatacacttaaaaaaaaaaaaaaaaggactctgggccgggtgctgtggctcacacctgtaatcccagcactttgggaggccgaggtggggggatcatgaggtcaggagatcaagactgtcctggctaacacagttaaaccccgtctctactaaaaacacaaagaaattagccaggtgtggtggtgggcccctgtagtcccagcttctcgggaggctgaggcaggagaatggtgtgaacctgggaggcggagcttgcagtgagccgagattgcaccactgcgccccagcctgggcgacagagtgagactgcctctcaaaaaaaaaaaaaaaaaaaaattggactctggtttctaaatttaaacgtttatccagtgggctggtagctgtcatagggatagaaattctaggctctaggactctatcactagtaaatacagggaattaaaaactccaaggagtatttttcatgtaaagcaaacaaacaaaaaaggccttgagtcttaaaagagagagaaagagttgttgaaatctagaggcacacctagtaagcaagggtaatgtattgcatttccaggagaaaatgaacaagaatgtaagttacactgattcctgccctggggtaatgggtgggtttccttttcagctctcgtgccaggtgggcattcgcctgaactaggaggactcggggggattcaagccccctgtctctaggttgctatgagctttcacatcttcctctggtttatcccccgcccttagcacgaggtggttgcagcgtttcctaatataaatgcaagcaaaataaaattagaaatgtgctggtcgggggaagccagctacccacaggcgccgtaaattgccttttcctctcacccctactccctcctacccaccccttctcactcccatcaagccaccccaaataacctgccttgcctggctgagtcacggtttctggaaaagtggggccaagaaggttcctaacaagtcactggagtgatgattagtggatgatcagcggtcaaaagagaatcatgcatggaaggaaggtggataggattcattggcatgagtggcagatccgggaggactgcttggggcagactgtttgagtgacataggtcttttagggtcaagggagagaaaccagagaatgagggaagcacaagctactaaattttgccatcacagcagctgcctttgtgtacagtccctttgcctctgctgttccaatattgggatggttccctaccctcaggaaagtattcgcttgcctgtagccgcgttgaccctagcgcttgatgactgaggaacacttgtgttattagcaacccctctttcccactattttaaatgaataggcatacttgtatccatgcagatgctgctttagagtttagggaattacaaaatcaggtacaccctagagtggggtttctcaacagcaccagaataatgggatcagtcctgggcacgaacatttttccaagcagagtagtctcacatcccttgaaggctgagaactctcatataaaggcattccacaagttgttttagaaaaaaaacgagaaaatagcctcaatatttgaggagtgtagttattaggaataacttacgctacatgaggacaaatacctaaagcatgtgggccttaaaacctagatgacaggttgataggtgcagcaaaccaccatggcacatgtatacctatgtaacaaacctgcatgttctgcacatgtatcccagaacttagagtaaaatcaaaaaataaaaagaataacttaggctacaatgatgatgtcggtgctggtgttgatgaaggcaatagtggttacatgtaacctagtatctagctcttaccgtgccactcatattttgagaataattctatggaacacttgacttgatccttccagtcatcttgtaaggcaaatatgattgtgcctacccttgcttttatagatgagcagaagtaaatgaaagccagagattggaataggttgccaagactttactgctaataggggttgagaatggagggacataggttatccagaccctgaagcccgaactccctaaccacctcaaaacactgtcaggatcaggagaaatgcagattacacggaacaatatctggggcagaaaaacaatgaggcatcagtttttccccctttatcagtggttccccattctggctgcaacacattcgctgaggttgccttaaaaaatcacgttgcatggatccaagcccaaaccaattaaagataattttaggaatacgggactcagtgatcagtatttctttaagttcccagtgtaataggcagccagagttgagaaccattgcctgacattaaagattcacaaaatgtggtccatgaatcagactttaatagatctgttccaagttttcatgaatgagtatttagtaaagatgtggtgcatggcttttcctaattctcaaagggatcctctaatgccaaaaaaaaaaacacaaacaaggtgggaaatcattcccttggagtatgatgggagcttaccgtgtgcctggaactgaagtggatcttgagatgagctatctcatttaataatcctaacagccctgatattgtcccattttatactcaagggaccgaggttccagaaggctagggaatatgcttgatatgtcatcatgaataacggatagagccataaaccaactcaaatctacttaatgtcaaagccagttattcttaatagacttctctgatggatgagggttgaaaaagtcctgcccagcaatagggggaacgactcaaagacagctagagggctttgccagccagagggcatgcaggaactctgaagtggtgggttgttaagaactaaaatattccatttgcaccgcagagctcagaattaatttccactgtcctgatggagcaggtgggaaggaatttgacctctcccctttgcctagaaactggtcctttctggaagcttctgagcttgctatggaaaaaaaaaaaatttttccacttctttcccctgctaccttattttcttgttctctgaccatttatctcaaacaaggaattattatctttctaatgaagccacagtagacccttcatttatcctaggatatgtcacccctacaattttctgtgaagtgtttttttctcaaaagacttctgaaattgaatttcttacgcatatgggaggagaatgatctttatgatgacacgatgatcttatccagcaaatatatttccctgtagatccctactttagcagatggcatgatcggggtgctcaagctaaacacttctttgtcctccttaattcctctctcatgggcagactgctcccttcctattctaaatcaccgtgtcttgccatgcctctccgatccatccactgcctccatctccatcatctctctggtccaaacctcatccgtctctcagacaggaaaccgctgtggtttctgcttggtcaccccactagctgtgctcctacctcatcgtctgcagccagagtaataacttttagtacaaatctgatcatgtctgagctacttaaaactcttctgtggctgctctgagccctgcacataaaatccagaacccttcacacaggctaccgtatactgcgcgatctttctttttgctctccagcctaatttttctccatggtttccttcactgtctcaatctcacccctgcaaaatgaagtagacacatgttcctcacatttaatgtctgcatatatgagattagaaatgggatagtctgggtgtctgtctcacagtgaaagagttttgtttattctttttattttattttactttaagttctcggacacatgtactgaatgtgcaggtttgttacataggtgtccacgtgccatggtggtttgctgcacctatcaacccatcatctaggttttaagccccacatgcattagctatttgtcctaatgctctccctctccttgtctccaccccccgcggacaggccctggtgtgtgatgttcgcctccctacgtccatgtgttctcattgttcaactcccacttatgagtgagaacatgtggtgtttggttttctgttcctgtgttagtttgctgaggatgatggttcagcttcatccgtgtctccaagtgtaaattagttcaaccactgtggaagaaagtgtggcaattcctgaaggatctagaaccagaaataccatttgacccagccatcccattactgggtatatactcaaagtattataaatcattcttctataaagacacctgcacatgtatgtttattgcagcagtaattacaatagcaaagacttggaaccaacccaaatgtccatcaatgatagactggataaggaaaatgtagcacatatacaccatggaattttgtttattctttaaagagctttatgagatacgatttacacagtgcaaaattcacccattttaagtgtacagttcaatgttttgtaagtacatttactgagttgtacagccatgaccacattctaaatttacaccatctttataaccctcaaaagatcctcgggcagattagcatttcttcccccagttccccaatgctaggccaccactaatctattttctatctctaagaattggcctattctggatttttttttttttttttgagacggagtcttgctctgttgtccaggcgggagtgcagtggcgtgatctcggctcactgcaagctctgcctctcgggttcacgccattctcctgcctcagcctcccgattagctgggactacaggcgtctgccacggcacccggctaatttttgtatttttagtagacatggggtttcaccgtgttagccaggatggtctcgatttcctgaccttgtgatccgcacgcctcggcctcccaaagtgctgagattacaggcgtgagccaccgcgcccagcctggatgttttatatcactggaatcatacagtatttgttcttttgtatttgccttctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccactgtttttttcttccgtaaaatgggaataataatggcatctaccctagaccgggcgcagtggctcatgcctgtaatcccagcactttgggaggctgagggaggaggattgcttgagaccgaaagttctagaccagtctgggagtcagagtgagaccttgtcgctaaaaatttttaaatagcgtctacttcatgggttattgtaaaacttaaatataatgataggagtaaagggtgtagcacagaattgcttgaacctgggaggtagaggttgcagtgagcccagatcgtaccgctgtactccagcctgggcaacagagtgagactccgtcaaaataaaataaaaattaaaaaacccacaaacaaaccgagacaatgagtgtagcacagcacatagaatgtaattagcactccagaagcctgagctattgttataattcctcttttcattacagaaaaattcttagggtagcagttcctggtagttactgttttttcacaaatatgtatttactttttaccaagttctagtcatttattcattcttttcaatcatcctgtgttgtaatcattactttcccattttatacccaaggaaacaaagtcagagtattcaggaatgcacccagggcacattggtaaggaaaagtacagcaggattttccttccttcctccctccctcccttccctccctccctccctccctccctccctccctccctccctccctctctctccctctcctttccctctcctcccctgtttccctttccttcccttccctttcctttcctttctttttgacagtcttgctctgtcgctcagggtggagtgcagtggcacaatctcagctcactgcaacctccgccttccggattgaagagattctcctcccacagcaggagtagctgggactacaggtgcgttccaccacagctggctaattatctttttttttcttattcttcttttttttttttttttttagtagagatggagttttgccaagttggctaggctagtgttgaactcctgaccttaggtgatgtccaccttggcctcccaaagtgctgggattacaggcatgaaccaccacgtccagccaggaaaactacagcaggatttatgagcgaaagcaaccagtgaatatttggaagctttgttcctggtgttcgggagtctgctgtcctctgacctcttgacttccaacccctcgtccatcactctttatcttatccctcaaaaaaggcatgacaaagggtcatgagaggcctggttctgagaatataatcaattacttggcttgaaaaggaaaaaaaaatgtcagtgtttatttgtttttaatcatagggggaaggatttttttggtgaagagtcaccattcaatttcttctgagaaaaagctttatttacatcagtaaagattgcaaggagacatcagaaagaacatttttatagtgaaggttttgagatcctagggagttcatctgaaagacttacagcattgtcactactcactgcatgtgtgtgggcatgtgtgtacacgcgtgtgtgcatgtgtgtgcatgcgtatgtgtgtgcatgtgtgtgtgtgagtgtaggtgtgtgcgtgcatgtgtgtgtgtgtgcacatgtgtacctgtgtctgcgtgtgtgcatgtgcatgtgtgcacgtgcatgtgtgtttgtacgtgtgtggggtgtgtgcgcgcgtgtgcgtgcatttgcatgcgtgtgcgtgtgtgtgtgtgcgtctgtgtgtgtgtgtgtgtgcccctgagtagagctccctctgcagaagtcaggctgaatcatcccaccttgctgactctttctaaccctatgatcctttgcctgagtaggtggggagtgagtttaaaccttatgtcttattttccttcattaatttggccaaatcatctgaaaatcactattctctacctctcaaagatgtagatggtggtactaatttaaaaattgctataatactctaagccatcatcagtatattgttttctggttttcaccttcttcagtatgcttcctatgagacagagttagaagtggaaagaggtgaagatagagatggtgaaagagggtgagagatttaaagccatattcgatcccagtgagagagctcatacagaagaggcatagttgagagagaaaatagcaaaacagtaactaggtgtcactcttttaccagcattcacagtaattgagctgagaaagaggtaaaaagtttttttgagtgattttgttaaccagaagacgtgatttgacttagggtttgtgggggtttgctgtgtgtgtgtgtgtgtgtgtgtgtgtgtgtgtgtgtgtgtgtgtgtgtgtgtccttttgttcctaactggctgtgagactttggtaagtcatcttaaagtgttttttttttttaaagtagttttcagcagagattgccttttattttttctcttctactgcacgatgcaatcaggaacctgtctagaagtatcagaagttgctgctacattttggtggacttgcacctgactcacccctccagcctcgatgcatcgcatgcagttagcatgttcagcacaatcttctctcttgggtttgggcaggcatatggtctgtgcctagcagagctgatattgctggttccaaaaaactgcctgttacatgctggtggtcacaagagaagaagaggtgagaagggctcggagccagacaaagcacgcctttgtaaatgaatgtggagttggccaccagcagtcttcattatccccgtcattgcaggcagctgagctggctttgtgtcagccctgctcggagtagccttgttaattcacccccatgaaaatggaagtttcatacacattgacataattaatgaagaggcaggcagcatgctctaccaattaacaccacagggaaaagtaaaatgggctttcttttggcatattgtgccaaagttaaggactgtaagacacagcaaataaatagagatgcttttaatgagctgcaagatcgagctgaataagtcagaaaggagtgttgggtaaacactgccaactctttgcaccgttaagagtaattgatgagcatagttgaaagtttggggggaaagagaaccgtcggctgctccaaccgtgttcatttataaatgcatctttccctgaaagctactgttaggtgtgtttaagggtgtaatgtgcaagaggaaacaaatatgacagacttgctattttgtagtgcccagaaaatatgaggcatagctgttgtagaaagaacaagcgtggcggatttttcacacttgatgggattgtttttgtcaaactcggagtaaaactggctcctctgccgtatagatccctgctctgagtacaccctggaaacaggaagcagggaatctttaagagtggtattggaatgactccattccttttagaaaagccagacggataatttaatttttgttctctatgtttgtgatatgaaagcatgaccttccaccaaaggatttcccattgtttctgagagtgagtgtatttatataaagaagttttctaaccaaagagaaatctgttggatcaaaaaatagaatgatcagtagggtttagtagctatttaggaaattttctgaattcaaaccaattgaatctgagttcagttggtttttgttaatgtggtgtatcttgttcgattaagccttcattttaaaattaaaggtgtcttaaatggagttgcattgtttgaccttagagagatcaattgtgtgtatcagaccaaacaaaattcaccatattcaacaattgtcctagcacccatctcccctccccactcccgacaaccatcatgacaaaagtgcaggaggaaaattcttgacattagcagacagcatgctctgaagcaagtaagagaaggataattcaatatagtactcgtcagtgggcgtctggtcctgcccatttttcctggctctgacatttcatcatgctgagtgagattccatttctaaacttggtgtcattcatgcaacatggccccaagtataggacaactacttaatctgttgttgctcaaagaaggtgcaatgcattacaatgctagagagaaaagtgttcataggaacctaaagagacagtgtgttgacaccaacatgggacctccctaagcaagttgctgagatttgattatgtgtgatttctgccttatgtgcccactttggatgtaaccctgatgtcaggtgtggctcttggaaacgacactattttctgttgtgcaggtatcattgctgcatcttcctctggttgaggacttgttacctggacttttgaattatcttctttgtacatggggggatggcagtatttctctgattgtgatctgtgaacttgccacaggatcatcttggatcctggctgagtgtggaatttccaggcccacatctgacctatcagggctggccgtacaatcagcattttaaataggcatcttggtatttccatgggattctcttgatctctatccacccttaacatcccatcctactttctgcttgttaagactcaggatacttctgggactgctctatggaatgggttcttaggaattctaaatgcatttgcatttcaaagactgatgagaaagggacacctgtccaggtaagacaagtcatcggtttccaactccagcaataagaacttagtttatcagatgtactgtctaactagtagaggtgtgttcgctgtcttcattaaaatgaagccaggttgatgtgactaaattttgatttgatttgctgcgttttatgtggtggcttatacttgaatgtctctataatatctccctgtgtattttagagagtgtgaattaaaacagctgccttgtacattgtaagtgttcaaaaatagtttgtaaagtgttagaataagggcttcatagccacaaggagggtctcagaaggtgatttggctagattataaaacacaaatattaacttttgacttgtttattctttatttttatttgattatttatttatttatttatttttttatttatttatttatgagacagagttttgctctgtcgtccaggatagagtgcagtggcccaatcttggctcactgcaacctctccctcccaggttcaggcgattctcctgcctcagcttccagagtagctgggattacaggtgcgtgccatcacacctagctaatttttgtatttttagtagagaaggggtcgcaccatgttggccagggtagtcttgaactcctgacctcaggtgatccaccaaccttggcctcccaaagtactgggattacaggcgtgagccactgcacctgccgttgacttatttatttgtaaattatcctgttctccacatatatacttttaaaaagcacttcaaaatttcagtgtggttattcaatggccatcaaagtttgttattctaccagaatggtcttatcttttacaagcgagatctaagaaagcacatacagaggcctgaaaagttgatttccctccttggaggagttcctgatttaacttcataaatccacaagagctgacatctcttcatgtccaaccacaaaatgggtagaaaatgatgaaatgcagaagaggcttctaagtcttggtctgcttctgtgatagaacaggagagaggcagcattttatttttaccattattagccagcctgtcagtcacttaaaatttttccgtgaagacacaaagctaagttttgaatactctgtgtcactgcttccagctgatattataaaaggcagtggtgaggatttcagctaaaaaaagattcgttgtttcaaaagcccagcctgaagtaagacagtgccatagacacgaccacaccagagggcaggtggttcacaaagggccttgcattcttctttgctcttgtttactttacatgagggcaaggagtctcagaagcgtaagatataatactacactagacaggcaagcagacctaatgtgcaaagtctcatgttggctatataggtagtttatatgtcagttccaattatgaatacattcctcagcaactagagttttctcattcattcttactgaactgttagggcatgtggcagcccagagctctgtcaaaatgaattgtcccccttgaaaagttggcaatgcaaggaagtgacaacctaatgcatgttagcactcttgataacaggacccagaggagacggcgaagcaacaattggatatgtgtctgggcactggctgttgttcctgcctgggttcaaatctcctctctgccgcttatgatctgtgtgcatttacaagtttgttagcccccttacctctttgttccttataaggttgtcgtgcaaattacatgaaatgatgttacaggtgtaagccaatgcctgacacacatatgtattctacagtaatcattatcaaagtggtaagcaggaaccagtgccatttcacaactatcaggtactcttctgggtactcatcatgaaagactgcagtgttccatttacaggcattggttggtggtttactaaagagtgtgtttttgtccaagaagttcactcactacattttgctcaaccagtcctctcatttgcagcgatttttttttctttgagcgtcccttgttgtgcagcataaacatctgggctgcatggtcagacccatgaggcttctcttccatctggccacctgttatataattaagcctgattgcagatgcgattctcatttagctgtcagcagcagcctgggagactagcaactgaggtgaataaaggtagctcaccacatctacaagggtagaagggctgaagcgaagggttgaccagccaggacaacaaaggttattgcttatggcagtgtcagcctaagagctcaagttcaagatcagaagcatgagagggtaagacctctaggggagtctgcataggtccaggtgaaaccctgggtgtctcttgattgtcagagcatgtaaatgatttttccgtgaggatagaatttgacagtcagtgctagaaagggcttcagagtttggtaagtctctttggtggactgcatggatagatgtgaaaagataaaccaaatcaaaatgtatattccattgaatcatgacaaattcgcattggtaatgcgaatgatagaatattataggttatgcttaagtgctttacctgtggaagttacttatcagaactccaaattttcaggggcatttgcacagccagtaattgtgcaggagatccaactcacatccacctcagcttaactgcctcttgatgctttcaagcattatgctatttatttcagtgtcttatgtttcagaactaaagaaatgttgaattaaattccccactatatgccgtcagtgtttcagaaaaaaaaaaaaaaaaaaagaaaaagaaatgagcaaggcaggtggatttctggcaaagttttgttttcatttctgtctgatagaaatgggagcacttcctaaaccaaaagagcattttttttttggtagaaatagccatttattaaaaaccataaatctgttatggctggttggtgagcataccttacagtttaattgtaccaagttgaaagtggacacataccaggataggcacacctcattgttccacatgtggcttcagtgctttaatgtgaattataagtacataagtaaagtacatattatttatgcatatgttgtatttatgacctttgggatgcatcagaggttgcttaggctcgttgttctgggtctttcaggatctagattttctatcctgattcttcctttttctaaaaaaaaaaaaaaaaaaaaaaaaaaaaaggctcagttgaggaactcactcagctcactcagtgcaatactataatgggaagagttccatgatgctgccattccagttataaaatggcttcttttagtcatcgtacaagccagcagttatggacagtgtttctctaaatgttagtaataaagtgtagcaggtttcatatcagtatactaattctaccaaaagccattttcagtcccattgacatttgaattctgcccatgcaaattagtggaacttgccatcacccttggcctataatgccccataccaagcatcaccagcccagtgcttctcagtcttggctgcaaatgatcgagctataaaaatactgctacctgggacctgcccctcagtgcctctgatttaactagtaaaatcagagggaggtttgagcatcaggatttctaaactttcagattttcagttgggcgtgtagtggggtgggttagggggaggtaatgtctccaaatggaaatgtctttttggttaaaataaagtagaaagaccaaataagtgatatttggggagagcaatgaatattctaaaaccaatcaatgggaattgtcattttatggttctcctgaatgtgagtgtccaaagtcctcgttattcaaagtgtggtccaaagaccagcctcacttggtaactgttagaaatgcagactgttatgttccagacacacctactggatcagaatgtgcactttaccacgacttccaggtgatttcatgtactttgagttagagaagcactgtcctagtcacagtgatgaggagggtgataagagtggcagaattcactttattgagcctctgctatgtgtcaagcactatgctaagacatttttgtgacatacttctccttaagttgttgccggagttaaataaagtgatatgtttaaaacactaagtgtagtatccaatatcaggtgttccaaaaagggcttatcatcatcatcatcacggtcattgtcattatcttaaatccatggtcaccctaggacaggaagcatgaatctagtttgtaagtgcacgtgatctcctttccatgggtgatatgggttggctgtgtccccacccaaatctcatcttgaattgtagctcccataattcctacgtgttgtgggagggacttgatgggagatagccgaatcatgggggctgttttccccatactgtcctcatggtagtaagtttcatgagatctgatggttttgtaaggggtttccctctacggttggttctcattctctcttgtctgccaccacatcagatgcacctttcaccttccaccatgattgtgaggcctccccagccacgtataactgtaagtccattaaatctatttttctttataaattaccagtctcaagtatgtctttattgcatcatgaaagtagactaatacagtgggccatgtgagatgatgagattgtgaccttacattcaaagataactaagctgtggtggcaatggatgatttgttctcctgaaatctttaggtggcacgggacagaaatccaaatagaattggcgtttgtcaaaagtagaatatattgtactttaaaaatgtgaatgtcagacatttgggggtggggggaggggggagggatagcattaggagatatacctaatgtaaatgacgagttaatgggtgcagcacaccaacatggcatatgtatacatatgtaacaaacctgcatattgtgcacatgtaccctagaacttaaagtataataaatatatatatatataaatgtgaatgtcatgtttctgagatgggtgtcaggaatagctgaatcaaggtgaccaaatggcgatgctctaaggaatgggccttgctgaatctgtacactctgcttttcttggcgtccactttatttcatgtcatattctctccaaatagtggcaagatgctcaccctcaactcaggactgagatcctatcactttgtcttgaccaggagaaaaagagcacctcctttacaatcatgaaaggtaacatcccagggataactctcaggtaccctgtgcacatccctgagccagttactcaagtcagaagcatggatattctgatcaggcaggttggcttcaaggatgaatcaggcctctcatgaactacaagctacggagttctctgaaactggagaagaggttcttcttcaaagaagtgcagtgtgtaatgcccacctgaagagggaaggaatttccagcaggtgtaagggactaatgtccactacaggccctcagttaaaagagttgggtagaaagaggtggggtgtgtgtatgtgcagcctgcattgactctccacttgatgctgtgtacattctgagggcaaaaccctgaattttccttgggtctgccgtaacaaattctctcaatggtgcctccatagggagaaaggggccaacatctgggggttctttcctggaacagtgttaagtgctttcagagttaacaagttttatattcaaacaactccataagatgagtctttcagacttaatttctaaaaccgcaaaaagtactgtagaggagttcagagatacgtctaaagtcacagttaatcaagaggactggtaggattcccagctcacttcaaattcatactcctgtatattcctctttataaataagtcagtgagcaaattatctcattaaaatgtaagtcagagattgccaacttcaggctcacaggcaaatggactttataacttgcagatacagtgggggtattttcatctgtgtgtctatatgtatggatgtatttacaaaataacattttatgtaagaatatgaatttctggcttgtcttcatctctccaggataaaaaatggctaaagttgagttgtggttgtcctctccggcattgcacactttcttcatttcccccagcattcttacctggccagtttctgtcatttatagaacctgtttggtcctggagatatttgagtttgaaaatcctggagtaatagtaccccattatgtcactcatgtacatggtagcctatgcaatgtgtcattccattcttctttaactgttgcaaaacatgccatgtgctctatctgtatatctctctctgttctcactgtcacataccacacacaccccaccccacccccacacacacacacagcaagggaggaatttgcgtttgctttgctcttttctttccctgccccctctcacttagctcactgcataatcctcctctcgtaaccttcaactccacaatgcaggaattttgcatgctctgtccccaaccgtattaataaagcacttaaaagtatgcgattttattcagggttatttatctaactgtctctactgaagtggtacttctgcagctcttcagacgcagtggtttccctgggggcagctttcggagtccgaaagcattgactgaaatgcaaagcccggatgccagctgcacgcgcaagcattccaagcccagtcattgtagccactggagatgggggtgggggatttgagtggatgggtccttccagcgggcatttgggtcatttggcccgtcgccctgcctgcaggctggcctgcacgcagcacctggcctaggcaccctggaatctctcccttcctgtggcagacacaggaaactcctacctcatcacggcagctgcatgtgtgggtaagcccacggtgatgatgacttctgtactggctgtttttactccttgctttaatgatattagctcacgtggttatcctttcccttctagcaggatttttccacagccagacaattctttgcggtgaggaggccaccctgtgctctgtaggatgtttagcagtatctctggcctcaatccacaggataccagtagcacccacccaccaggttgtgatgacccgactttctcctgatactgcctgatatcctctgtgggtgaattttcctggttaagaatcactatcttacaggaaggtggcaaagatgagagtatcagactgtaagttccgcgagagcaggcattgtgtctggtttggtcgtggttgtgtgccaacagatagtagattttcaatacatatttgttgaatgaatgaatgaatgaatgaacttccgactgatcagagctgaggactatattcatcctcaaggtaatataatgattattattcacatattaggaggaaaatcaagggttcctttttatcttctcctactaccccccgctgtcattatcaagtgagttcaactaagatttgcttaatgaaaacctaaatcattatggctctcttaatcagagtacctactatgtggctattctaaataggtgttctcattgaacttggttttctcagtgattcataaagatggttaatagcaatgaaattttacagattgggaaactgaaaaccagagaagtgaaggaatttgtccatggccacacagccgtaagggagtagagacctgattcaaatcttgggctagaaggattctcagaatcttcttttctctttgcacctgattggctgtgcctctcgctttattcagtcaaagctcaattcaggacgacgtgaaagaacattaattccaaggtgaaatgtgcaagaggttaagtgaatttgaccaagtttcccattataatttattttgggggaaaatggattaaaaacataatctctcggttctaacttcacgttcacttgaaaatgaaaagtgagtgttttacagatccacagcttcacgttatctgttgcattttgagagagaagaagatggatgcattggggtagagagtataataatattacaaggctttatatggaaggtcaagtgaggggaagatgagctggaaggatggggaatagcaggctaagaaagaacaatgcataacagatgtatctaaactgtttttaaaaatggttaatagactcaaggagaaatataaagaagggagcactctgaaaggtcagaacaagtagtcaagtaagaagcaaagtaatttaaacataaaaaggaaaatccgcagatatttctttcatgcttcagaaagcgtcggccttaaacattgcagtgtcccagtgatgcattgcaatcttctgcaagacactgaagtattttatgaaggcatactttttcctcctaagttgaggagaccctgagatggcccaaatttcctttaaaaatgaaatgaaactgctcggctttccttacattaaccttaaagataatgaagttttggtccttgccctataaaggatagacagaaagggcctagtcacatcttcctgtcatctatgtagatgatgtccttattcagaagtcattatatgagaatatgagtgttatgggaaggcaggaaggaaggaagggaaaggaaaggagaggagagggaggaagggaaggagagagagaggaaggaagggagggaggggaaggagaaagggagagagaggaaggaaggaaggaaggagaagaaagatggagggagggaagggaaggaagggagagagagggaggaagggcaaaggaagtaagggagagagacgaaggaagaggggaaggaaggaagggagagagaggaagcaagggagggagggggaagaaggaagggagagagagggaggaagggagagagaggaaggaagggagagagagggaggaagggagagagaggaaggaagggagagagagggaggaagggagagagagggaggaagggagagagaggaaggaagggagagagagggaggaagggagagagagggaggaagggagagagagggaggaagggagagagagggaggaagggagagagagggaggaagggagagagagggaggaagggagagagagggaggaagggagagagagggaggaagaggggaaggaaggaagggagagagaggaaggaaaggagagagaggaaggaagggagggaggggaaggaaaggggagggaaagaaggaagggagagatggaaaggagggaaggaaggcctcctcatcctttttttctgcgttcgtttactcatttcacttttttttttaattggacatctgtatatgtcagtcactgtggaagacatttgggaaatgatgactagtaaaaacccaaacaaaataaacaaacagaaagtacctgccgtcgttgtctagtggacaaggcaaaacatcaataattcaataattactccgtgtgttggggcagggtctgttttcttgcagtcatgcctcagttttggcttaacatatcagcttccatagttaacttattcatctgcctgcctctaaatcccacagattttgagatgtagatcagctttgtcctctcaagggtttcacattcaggaaagggctgacccatcaggcatgatgaagcactgcttgacagattcagcctccccagtcaatgaaggaaaggaaaggaaagcaaggttcgtttcatttcccaatcacgtgatggcattgggcactaccactagcttctgatgcattcattctggaacttgtttgtgaaaatcagttgagatactaaatatagaaggggagagccacttggagttgaaagtgacctttaaggccacttctgtcaacttagcaccaaatgcatgaatttacacaactgaatttctgctcttcggacataaactttccccattcttttttggtcagtttgtttttaccctgcagagctgatactgcagagggcagctcattttattcctggactatagttcctcattttgtagaaatcaactttgtcttcccaaggttactggtgttaattttaccttctgatgttaggtaaccagtcactggtttccgaagctgggtctgagtcccagaattcacattgatcagccatggtacctgaacaagcacctctagccccctgagcatcagggatctttccattaagtggagagtatcctccagaatctacctctccagaattcagggtaagataagtatggttgtttggatcagataggttttgtctccatggtagacaagagaccactatagcttaaaactcccattctgccaacagaacaaccgaaagagctagaatacgcttgtttatgtgtttgttttctggtagctgggcaaagaaataagggagggcttggctggtttgtcttgtaccatgtgtttatccttaaaccaatcagaatgaatcaggaatcgactactatcgttcacgtgactaaactggagtattagagaatcagcagggttcatgatgagggagtatagctgtgttcactgcaacacagctcctaagagcaaacagtttaatcagctcatttatcatcctaaccaaacttttaaaaggcagttcctcgggaagttaagcatagaattaccatatgacccagcaaacccattcccagttagatgcctaaaggaaagaattgtaaacagattcacttgaatccacatacacaaatgcttataacatcaccattcattacagccaaaaagcaaagacaacccaaatgcctatcaataaatttatcaataaataaatggatgaacaaaatgtggtctatccatacaatgaaatatcattgagccataaaaaggaaggagctactgttacatgctacaacgtggatggacctcaaaaacactgtggtaagtaaaagaacccagaatcaaaagaccacagattatgtgatttccttcacctgaaatatctggagtaggtaaatccacaccaacagaaagcagattggtggttgctacaggctaggaggaaggggttggggaataaccattaaataggtacagattttgtttcggaatggaatgatgacgtattttggaactagataggggtggtggttgcataacatttgtgaatgaacaaaatgccactgaattgtttccttttttttttgagacagagtctcggtctgtcacccaggctagattgcagtggcacaatcggctcactgcaaattccacctcctaggttcaagcgattctcctgcttcagcctcctgagtagctgagactacaggtacataccaccaggcccaactaatttttgtatttttatgagagacggggtttcaccatgttggccaggctggtcatgaactcctgaaaactgtttactttaaatggttaacaaccaccacaacaaaaaccatggagaccaagggagaaaacttaagtgagatatataacttgcttgagctatgtgttcattttataaaatgggcaaaagatgcctatgtctttaggttataacaagcttcaaacaagtgaatatttataggggaccaggttcctggcaactattaggtgctcaataaatagcctgcatgcaaatacctccccacacacatatgcccacttgtacccacgtaattcttatttaatggtgttcttttaaagaatgagataacaggccaggcataagcggctcatgcctgtaatcccagcgctttgggaggccgaagcgggtggatcacctgaggttgggagttcgagaacagcctgaccaacatggagaaaccctgtctctactaaaaatgcaaaattagctgggtgtggtggtgcatgcctgtagtcccagctactgagaaggctgaggcaggagaattgcttgaacctgggagggggaggttgccgtgagctgagatcacgccattggtcattacactccagcctggacaacaagagtgaaacttcatctcttaattaaaaaaaaaaaaaaaaagaatgaggtaacagaaacaaagaacttacctagcacatgatgttagcaaaccctgtcaaatttgtattcccatatttctcaaaacttgttcttctttccctctccacaccggtgattgttgtcaccctgctttcctggactgctaaaataggctacatttcccttttcaatcccttttgcttgctcttgatgttcccaacagcggccaaagaacccatctcacaatgtacataggatgctttcccttcccagttaaaaaccccactgtacttagagttaatcccaaccaccttcatataaagccctggaagtctggctcctgccaaccttgctaaactcatcctttttttttttttttcctgattcttatcccattgactttgactgtttctaagctggctctatcccaagtgaaaagtcacctcttcaaagaccttttctatttaaaagaattatcccagctcttctatattcttttccatgacatgttattcacgtgcttccaagtcctgatcaccatttgtaattttaaacattgagttgcttttccttgctctttctcttattcatgaaggcagctctgctgttgaacacaatacatggtagacagcaggccgtcgatcagcacttgttaaatgagatcaatgtgtggaaattattattaaagtcctgaaaattttacaaagtctattttgctctaatgtgtacattggtggtatagtctggggaatacatgtatagtttgcattgtggacatccgattgtttccctggatgctgccctttcaacaagaaatgcgaccttagcaaaagatgggggccccatgaacttccaactcgtcttttatttatggtatatgtgtcagagaaacataacaacatttgggaatttattaaatggcagttttctcttcaaattcttgctctagtttattgtgcctaatggagtcttactaagggcaaagctaattgacaacaaggtttatttctgccgatcttagccaaaaagtcaatcaccactcaacgagagctactctgactctttggccaatggacaaatttccatcttgactggcttgactggtcctgggagaatagaagtgaatgagcttaattctattttgatacttttcattttcagcaaaactgagacaacatcaaggagttacattatcatgagaagagaggggttgcatggaaattatgtcacaagaatgcttggtcaattttcattgcattcagctctattcacaaaggcctgttttgctggcagacgcttttgtcagatatgtggctcacggcaggcaatcaagctgtggcatgttgcagagggacagtgagggctcacatgctggaggcagaggttactcaggccaggtaatgaataaccccactggaagagcaaaagagctcatttctcagtggtttatcttccagtgggttggtgttgtgtataatacagtgagttgagatgaggaatctatttggttttggttccacccctttgccagcaaaaccacaaagtgggaaaagctaacctttgggaggtaaaagctaacagtgcaagatgccatcaataaaataagctccctcatcagtgaagaagggggaaccaggctcaaagtttgtcttctaccaggaatataagcatcgtgtcctggatagtatgaagcatttaaccatgaagtcttctgttgcaaatgacatgtgtatacatatgtgtgtgtgtgtgtgtgtgtatatatatgtttgtatgtgcttgtgtatatgtgtgtgtttgtgtgtatgtatatatgtatacatattttatatatatatgtatatatatatgttatatatataagttgctttcaccaaatccttgtaaataccctgtgctgaacggagaagtcagaaatgggtaatagactacattcaaactcattttcaatttccaaaaatatgcaaggcaccccatttttggtacgtggatgttttttagcatttaatggataacaattttgtatgtcccataagaattattcacagacatctcccaattccattttcagagacttactgtagacttgcttttatgcctgtagcttggatccaagaaatttatttctacctctgcagtccaaaaaacggaatgtctaacgattttttgcaaggcaagtcgaagtgctatggtggaattcttcttagcaagacaagcttcagtggaaggaagaatgtaaaacagaaaaagttctttaagaggtatataaatctacacatcggtagtagtcacactaataataaacattcatttggcatcatatatttttaaagtgctttaaaatgttgacattccttagaaaggagagaatagctctgggatgaggatttttattttacatttcagggatgggttacacagaaagaaagccacttgttcattattgactaagtgtggcaaccagtgtgaccattccctagtggtatttttggctcttggcttagaacagggtatgtatccaggaggcaagagaatgagtaagtgacctactgtactgaaaagaacagacagagatgtagtcacaaaccagtttagatgagggacctttgtttgtaagatgtaaacatcgtaaacaaggagatgctggtagtttttgacattttatgggcccccgtagcttcatcgcttatgtacattgaatggatgtatgttgtgatggaaaggcagtggctgcgtttgccctttcaattgatgggcagccatatcttgggatgaattagccttttgtgggatgaatatgatgcctccctctgccatgacatcaagaatatcctctttgagggttggagagaagttgtctcttttttcctgccttgcaatttatatattaagggttgaccaaaaattgttaaaaatgtttaaagctaagtaatatcctgtgctagcctgaactaaaaaataatgccttattctgacaattccagtttttacagttgaaggctattaatcaatgaagcagtgtggatccatataaatattgatcactgtctccttgccctcctgtgaatgttctctcttaatgacagccaatttcaatattcattagaaagggtgcattttctggcttgcaccattgctgattagtaactagagagatttaactagaccatggtcattttgtataaatagttcctcagatcaaaaagatcctggttattgtctatctggacttagcttacctcttcaacatttcagaaattagagtgttttcttgtttgtgtcatatcctgctcacctaaacattgctactgttaagcattaatcttctcatatttaatatataaaaatcaaagtaaatattcaagagttatatttagatctgtaaagggaagcccaagtgctttgtatgaggtgcgaactagggttaataggatgtatttaacaccatattgtttcagctcaagttagggagagaaggagatcatgtatgcaaaaagtagaacatttctccccttcctattttgtctagaggggcgtaccctcttttaaggtattgtcacatgcacaacatctggccttcagttctcctctccgctgtcatgcaatctggcagaatctctttctgctccatggttcctaaatgcatccatcccattgccattaggattctacttttggcattttccccatctgttttggtaattactgtcagatgaactgatatctctaagttgaaaatggccaccttttaaggtagcacattgtagtcaacttcccaaatcatgaagtctatgtggcttttagtagttgtttgcagaagtaatttagtaactttactttttcttttttttttaatttctaagccactgcaagcacgcaccagccttcagtggcctgaattattcagcagtcattaaaaatgcagtcagtgataaggcagacagtccttgtgcctgggtttgtcaacatatcttgtcctcagcaaagactaggttcactggaagcacgcaggatttagttcaccttctctagaatggctgttgttgggaggatttctagcaacattactataaatgatctgcctgcctctgtgttgtggtttataaactctgtgtaactaggataagctggctttggaagaggcaagccgttctttcactagaagggagaggttattgcatcacccatcagcaagagaggaattcaggagaggtagagagctgtgtggggtttgggtggcagccagctactttccaaaacttcccaggggctgcaatacagccgccaacccaaatgtcattgggataggccagcgtgccagatgccatcacagaaaataacttcccttgcctggcatctgggttcttgccttgtaatccagaagaccacatgctggatcagctggtcccagcggggaccatgagctcttccgtcctctctccctccctgtctgctgagcatttgaatgagtcatcagagtgcagaatggattttggccatgcccttaattgagtgttctgtacatacaataataattaataataatttgaactgatccttctatagttttgtctctggaccaggcactgctctaaaggctgcacagattgtaactcatttacatatgtaacacatatctacatatctcattagcctgaagcacaatagaatgagaaaagtgaaaagcaaagtgcttagactctagatttggaccaactggcttcctatgtcaactctgcctctttcagtataggtgactttagaaagtaaattctgctttctcaagccaagcgtccatgcacagacaagggaataaacaaaacgtggtgtatactggaatattattcagccttagaaatgaaggagattctggccgactgtgtggtggctctagcctgcaatcccaacactttgggagggtgaggcggacagatcacttgaggtcaggggtttgagaccagcatggccaacgtggtgaaaactcaactactcaaaatagaaaaattagctggacatggtggcacacacctgtgaagccagctactcaggaggctgaagcatgagaattgcttgaaccctggagatggaggttacagtgagcccacgtcgcgtccctgcacgcaagcctaggcaagaaagcaagaccctgtctcaaaaaaagaaaagagatgctgatacatgctacaacatagatgaaccttgaggacattattctaagtgaaatgagcttgtcacaaaagaacaaatattgcatgattccacttatatgaggtgcccatagttgtcaaattcacaaagacaaaaagtggcatggtcgttaccaagggctgggagaaaagaggaatggtgagttagtgtttaattggtacagagtttcagttttgcaagatgaaaagagttctggagatgaatgttgggaatggctgtgcaacactgtgaatgtacttaacactactcaactgcagacttaaaatggtaaaaaaaaaataaataaataaaataaaaattaaaagaagaagtaaattctgctttctgcacatctgccagctgcccttgtctaagttcccaaaacagattctgctttttgcttccacagagcctttgcatggttgtttccccttcctgcaatatttacttagtactttttcctaggttactctcctcatctttccaaccttgggctacacacgcacctttaggaaagcctacttctgtgttcttcccatcttgtgtacgttccaaattctgaatctccaataaaatgaatatgcatttctttctctctttttttgtaacttttattttatcttcaggggtacaagtgcaggcttgttacataggtaaacttgtgtgtcatgggggtttgttgtgcagattatttcatcacccaggtgttaaacctagtacccattacttgtttctcccgatcctgtccctcccctgacctccacctgccaagagaccccagtgtgtgttgttcccctctatgtgtccacgtgtttttatcatttagctcccacttatacgtgagaacatgcagtgtttggttttatgttcctttgttagtttgctgagaatgagagcctccagtttcatccatgttcctgcaaaggacatgatcttgttcttttttatggctgcatagcaccccacagtatacatgtaccacactttctttatccagtctatcattgatgggcatttaggttgattccacatccttgctattgtgaatagtgctgcattgaatatacacatgcatgtctttttattatcattttctcctttgcctttcctaaaccatgcagtttgatatatgatgaggctacttctaccattgatgtaggtactgtgggtgccaggatgcccaggaaaaggtggaatcagccagtaatcccagcaatttaggaggccaaggagggtagatcatttgaggtcaggagtttgagaccagcctggacaacatggtgaaatcccatgtctactaaaagtacaaaaattagccaggcgtggtggtgcatgcctgtaatcccagttacttgggagtctaaggcaccagaattgcttaaacctgggagctggaggtttcagtgagcctagatcgtgccactgcactccagcctgggcaacagagcaagactgtctaaaaaataaataaataaataaaaattggaatcggctgggatgatacctcaacaagtgaaattgtcctgtcaagaccatttgcatgtgtgaaagaataaaagaaaaacagaaaacactgagcttctctgaggctttattgccccctgataagaccgtgagaactcatttgtcttatattagatgattattttactcttctgggtctttgatctaggcagttagctggttagaatttgctgatgttgtattcatgtttctttgaatcagcagtaactcacttagggatgaaaatggggcatttggcttataagaagaaaacaaatatcatttatattcatttttctacttgaaactactacttgaaaactgggcccatagagttcgttgtgctaaaaggaacatttctcattggtagttagtatttcaattgtaatcaaattccaaaacttcctacctgttgaaactataagatgatggtgacgattatttgagactgagcctagctctgtcgcccaggctggagtgcaatgctgcaatgtctgctcactagaacatttgtctcctgagttcaagcgattctcctgcctcagactcttgagtagctgggattacgggcacccgccaccacgcctggctaatttttgtattttcagtagcgaaagggtttcaccatgttggccaagctggtcttgaactcctgacctcaggtgatcctcccgcctcggcctcccaaactgctgggattacaggtatgagccgatgcatcctgccgaatctataagatttaaggataataataatgaatgtttacggagcagtgttcatcaggtagtgttctaagtactttacatatattaatgatcttcactatgttatacttgtatatcaccatctgtgatcatctgaagcccttacagtttaagggaaaatctgcatttgatacatatagtgtgtgttaaagaaacatgttaaagatgaaggaggagtatgttattttattgtattgatttctgtttctaaatactggggttttcgtggtgttttttgtttgtttgtttgtttttgtttgtttgttttgagacagggtctcactttgtcacccaggctggagtacagtggtatgatcacagctcactgcagccttgaccttctgggctcaagtgatcctcccatctcagtctcctgagtagctaggactagaggcattcaccaccacacctggctaatttttgtagttttgtttgtttgtttgtttgtggagatggggttttgccatgttgcccaggctggtctcaaactcctggactgaagcgatccacctgcctcagccttccaaagttctaggattacaggcgtgagccgctgcacctggcaaaatattgttttttgaaactcttcttgaagtactaatgttgctttagatcttaaacagcagcacaaaaagtttctaactttgttggaacattctacttttcccccacaccttcccaaacaattctcttaatatacaacaatatctgttctggctatcgtgaaaattaagccactggatttgggttggaaaagaaggtttatttagcgcagtttttagtatttatatcagattgccatttctggcttgagacccgaggcagaagtatcccctgcatttggaaaatgaaaaatccactggaggattgattattcataaccctgaaatgtattgccccacctctaccataaatcacacggagtttttattctcattagctgaattctggcatctcagtctcggcactactatttattctaattctctcagcttgagtaatgggtgtggcccaagcaggaagcaggtcacctcctggcccgttggactatcttggaaagagcatgtgattccctgtaggattaggggatttgcagttcaatgggcaaattatgcattccaacgtctaagtgtggttgtttaattaaaccctttggttcattcaagatgactaaaatgtttcttgaaacaggacatcttgaaagttattaaaatttcacagcaaacacttttatggcaggaacttttatgaattttgtttgggttggggcattgcaagagggttacttaaaatgttttatctggaatttataataaagaaaaaacatttcttctttatgttggtcatattttcagtaagagtgcattacaaaaaatctacatctggatgacaaatgtgatacaaatggacaaatatatatgcatatacacaaacacacacacatgcccattttctcatccccccttctttttctctttcaatctgtctataaatgtagatactcacatatacatatatgtttatacatatattaaatatgtaaatatgtatataagtatatatgcatataaatatacttatatgtgatttgtgtatacataattacatgagtgcatatatacctaaatatgtatatctgcatatgcgtgtgtatatatttaagggttttcaactttggccctcttgatactttggattggtaatccctttttttgtgcagtgtccctgaccactagatgctattaccataggcacctcagtgataacaataattgaaaagtcaccaggaatttccaaattttccttctgttgagaacccctgcttattgcttggcacacatgcgcacagagaaacccatatatgtgtaggtcatgcacttactgtaagagacatggaaactactgtctcctagtttatccccaaaggactgacaagagtgttcactgaaaattcagagacagggttgcatgtaaatgtctgaataaaacacatggaaaaataaataataggcatgacatatcatcattggaaaggaaggtaccttctgatgcagacaggttgtgccacatgacagctgtgtgagcttgggcaagaaactagatctctctgagctttagttcttttatgtttgaaatgggcaacatcatgattatttttcaccacttgttgaatttatagatacagtgtacctccccctgcatcctcattacacattgactaaggaaatggaatggtctggaacacgtggcaacttggacatggggaggtctcttcgccattggctgagagtaagctgaacaaactttccatggtgacagctgcaggatgctcagcatgcagtcaattcagtccaacatccgtgcttcgtgatttgcatccatgtgacttgaagcagccagttggaccaggtttctgattgagtggccacgtgcatgatgggttgggttggactaactagttgtctgcaagaactggctaaacggctcagccaaattttctgtttgttgattcagacccgactgactttgccaggtttggactgtgctggtgagagagatatggagtctgcggacagtttgcaagcagtgcctctcgacattttcatcctgcatatggggctgtgtcggccttacctgtctaccttctttatcttcttccttcatttgttctcttcctcctcctcctcttgtttttgttacttggattttcaggatgtcaagccctggcatttttaatataaattggtaatataataatatattccctttattctttgtcattagctgaacgttttaggaatatcaatatagaatacatttgaatgttttcattaaaattgtaacacacccagtattaaatcagaaagtgaatgttcagcaaacacatattgatctcttgctacgtgccaacaactactccaagcacttggcatgaatgtaccacatttattctccaaaccagcctataggcgtggtcagggtgtgccacgtgacagctgtgtgaccttaggccagcaactagacttctctgacctttagttcttttatgtatgagatgaagagacatcatggtcactttgtaaaatttattccaaaacaaaaagatgtggaagaaaggcatattacctttggttgacattatctttgtttgtaggtgaagaaactgaggcttaaaaaattcacatatgttgtggctaagcagaagggctccccaggaagttgaccccttactctttattagtagtagtattaatacattttgagagaggctgtcactctgtcacccaggctgtaatgcagtggcatgataatagctcactatagcctcaaattctggggctcaagtgatcctcccagctcagcctcccaagtagctgggttacaggcgtgcatcatcacatccagctaattttattattctttttggtggagacagggtttcgctgtgcttcccagactggtcttgaacttttaggctcaagtgatcctccttgcctagcctcccaaagtgctggtattagaggtatgagccactgcatcctaccccttattctttgttcttaatgattatgttataatctgggatttcacataatcaaaactcttaatttctaatggatttaagagattcattaaacctctgaagtcacatacaaaactcgataactaacatacatttcttttttcctggagagaatgttcatagcttttaaatcaatatctcaaaatgatctttgttttcacagcaagattaaagataatcattatgtaataaaacttttattttctgtttcttaggtcagtctacagctcaatcttaaacagcagtattgtcatcaaagggtaactccagagaaaaaaaatcagagtaaataaacatttataataatatatctttcatcccttcttcagagtctgttctaggaaaatgccaaagtattccaaaaaaaaaaaaaaaaaaaaaaaacacccttgggcttttcattaactacacttcagtccttgagattatcttgatcttgaaagttgctggcctttgagcaacttcttcaaaccctcaagatgcatccccatggaccatgctggtcctttttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccaggacctgggaggtcatcacactcgaaggaggcaggctgggtcatcagacatatggctgtcttggttttgtttccttgttcccacttctgctcatgatgggcctaaataagagatattcctctactgtaagaaaagctccgtatcccaagtgaagctaattggtaattggtgtttcatgtcagaggcacagtagggagcagtggggattgtggcaaagtgaggaactcatgcctgccttcacagtgcagctgctcctcagctgcataccattttcatgaattagaaatataccagactttctgattgtttacctaagagagtctgaaaagtcttatttctaggtgctgtatgtccatttaattgttgttacttagtctagattatttttattgataacatagaacagtggtcttacatgtctctctagatcctaactaaaataataaatatcttatatttcatttgaaaaatatttcatatagttatagaattctagattttgagtaattttctttgagagctttgaagatgttatttcattatcttttgtttcctgtactcttgagtttttttaaattttattttaggttccaagatacatgtacaggatgtgcaggttcattgcataggtaaacatgtgccatggttgtttgctgtacctatcaacccgtcacctagtattagttgaatgtttgaaactcaaggttaaaccatacctgggggtgttatctggtcttcaattcaccactgttgaccaacagaggctattatgatttgcaaaacgtattttcataatcaacaagacaaaaataaataaaattttaaatctgatttttataacttttctgagaggttaaacttttggagagctagagaaagagctatgctgataaacaagcttacttagccttatgtttttgtttgtttgtttgttgaaagatgtttgcctgctcacttaaggatacttagcattagagaaaagtagcttttttgaaaaaagaaaataacttcgggttgccctttttgtccatcagtcttgcatagtgctttagacagcacttcatacactcatgcaactcttcacaaattaccaattactttcccctttgcgtttatctaatttaatccctacagtcttgcaaatagatattcaattctcccagcccatagcagcttgaaacagttcaacaaacacaattagcccatccctgaaaaaaagtatagattgcagtgtaaatagaaatttgtttttccacttcaagtgtggcacaaattatcacccaccttagatgaatgattaattccacaactgttaagtatgtttttacttttatctaagcaaatattttgagagtttttttcataacttagtttgatacctaagctggtaaatgttttgttcaagtttgctgaagccaagactaatttagaattagggaagttaggactgctttcaaatttgagagaaaatttggaaggaatccttagcctctccacagccaccaccctaatccaatgcaatccaattgcctctcacctgggcagctccagcagcaccctccctggattccctgtctccgtccttgctccctggcatcccccacagcaaagcagccatggagattgttctgaagtgataacccgaatgttttcctcttgaatgtgtgatttttttagtggcctcctgttgaaagcagaattaaatcaaactcgttgttttgctttcaggctctgcattatctggcctctctccagtctctcccttataactgtaccaaaccatggtggcatccttccttttccacaaacgccaagcttattatgaacctagggctttttgttgttgcacatctatttattgtcagactgtatggtcacctcctttttttttttttttttttttttactgagtttgaatgcaattattccttccctttcctccttggtaaaacagaactcttggagttttgttgtgctgactgcggtggtatcagcaccaaggacagcgcctacgtagcacatccagaggcttattaaatatcaggttcaacgactggctgactgactgatcaaagagagctacagcataaaggcttcagagtcaaagttgaactccagttctgccatccacgagacaggaaagttatacaacctccctaaacctcaattttcccattttacgacagggatgagaacagtgtctcccacattaggataccctatgtattcttttcctattggtccccagcaatcacaaatctaattggcaggtaacagtgagcacttgtttagtgcatgtgtctgtagtacaatggggtccttgatttaggctgcactcagtcatgtgtctgcaggtcagctggccctcaagtgaggaggctcagctttggagggaactctggtccctgtgtctcaagtcctctgctggagaatagtagctagtcagaaatgttctcttggtgaaggagaagtgcaagagaaacttctattgtgcaaacgccttcaagcctttaaccgcatcacactcgctgccggttaacattccttaaccaaagcaagtctcacagacacacccgcagtggaggggacactcacagccaacgggtaggaaagtacactctgcccatggaggtggagaaggagcaaatactcctctatggtgatctaccacacactaagagttgtgcaagataatgagtgttaagttcctggtatgtgataggcactcagtaaatgttagctaaagttgagaattactaatttttctgtaagaccctgtgcctgccacaataatatgaaagtaatgaatagttttatgttaacaaaagctaaaagcccccaggtcatccttaaatgaatgtatatcctgattcaggaatgccgtgattttaagaatacattagtgactgcttgtcatttacacatctcttaatttagctgaaatggaatacgggaaacatagcctctttaaatccaggttaagtacatttccattgcagggagcaaggtcggtgctgttcatctaggtattttaaaatgtggttccaaacactgcatgttctcacttataagtgggggctaaatgatgaggactcatggacccatagaggggaacaacacacactggggcctatcagagggtggagggtgggagtagggagaggatcaggaaaaataactaatgagtactaggcttaatacctgggtgatgaaaaaatctgtaagacaaactcccatgacacaagtttacccaaataacaaacctgcacatgtacctctgaacctaaaataaaagttaaccttaaaaaaatagaatatggttctggaaggaagaataaccgctgattttaggaagaactgtgaatgaaggcaaagacttcagagggagatggctctcagttttgagccttggtttctttatcagttagggatattaccagctctctgatagggtccctgtgatgtttagaaaagggtctacaaaccattaacacagtgagtggcacatgaacggctttgcaaattcttgctgcctttcctacctactgctcactcccttccttgttcataaaggaccgtgctgttggccattttgtcgtcagctcttctagtaggatgccctatgtgggtatcagaatacatttgtgcagaatcttctagctgagtcccttcatatctttccagtcatttgggggaaaaggtaggatctgaatgaacagagactttcacgcttacacttgctggcttagctgaattaggggtagcattacttaatttcacccatcacagatggttttacctgtcatctcagccatgagccaccttccttccagaactaggcatttcttctttatggtgagtgaacttagtttttgaccttcctttttataaaacactaatagttgcttataggaaattcaagtactgcagataagcaccaagaaaattagagttgcatgttattcatcatccagagataatgtgaattagcattatcattaattgatttttctgtatgtctaggcagagatatatcagggaaaatgctatttataacagttgcctttttgagtaatcatttagctgtcatctatttgtaatctgtatgtatatcctacctatatacataacaaggcaaatgttgctatgtatagccaacagccatcgcccaagaaaggcgggtagcaccatcttgttctaggagaggtccctttgtctgtggaatcccagataggtttgattttgcaagactgagagtgggagccagggaatacagcactgctctgcataatagagggagggaaaagtagtgttccaggaataggactgataggagagggaggggaagagagaaatgggagagggaaaggaaggaatcaatgctgaaaggaacagaaagctgggggttaggtggtatcaccaccaaccttcagctaagttgactacatttttaaatgtttttgcaagggtgggtttgtttccattcccctcttttttcccttctcttcattgtctttttctttccttcttttctttctattggatgaaccctgaaagtggtgcaatagagaataaataagataggaggagcctggaggacaataagaacaaaatctacctgagaatttgcaggaacctggggacatcactagacttccaagggccatagaaattggagctttataccaattttacttacatcaccaaggagaaagcatttttccagctatctgaattctctgtctttctctctgacttcccacattgtatatcaactgtttatatgttttgtagttttttaatatagctatatattatgaaaatttccttcttcataggcttctttctttaaaaaaaaaaagagcctgtaagaataatgaaagggctgaagaataaaatcattgaatgggtaccagatttatttttatgtattttttatttttggcacagtcccaattgctgagctttttcttgtgctatctctgattttccaccataacaaaccgacagtgatgagcaacattgtgtctatatcttaagcacacccaggactttctggagtcagttcctacaagtggaaatacttgaataaaggttatacaaatgtttaagccttttgatacacattgttaaatgatctcttcagaaaggttaaaccaatttacactctcaacagtagtgtttaagagactctttctctaaatctcctttaataatgaagagaagcattataaaatcctttccaattgccatttttataaaaaatagaacctatttgttttgcacgtatttggtaactctaagaatccctccccctttttttcccatagggttttgaaccagttgtgtttcctctgggaaaatctgcttcttcatgtctttcaagccttttattgattttcgagagaagtatctttatgttttgtttttaaaattcaaatgtggtgtttctaaatggtatgtgaagcatgatttcacttagtagacatttgtggattagccattaggtgaaaaataacactgaagagtaaaacaaatgctttttttgctgttcctgggagcgtgggatgcttatattaattgtttactggtgaccatggatgctgacacaatgattaaatgctttaaagccagcttaatgatataaagccatttcttcatttgtgtcttctaagtgaaatccttcctaagtgaaccacaagagtttcctgcttcatcgcctcagctgcagcctcagctgctgtgattacacttaccttgtctctgctttagttagtttttatcccctccctccaagaaagtaaactacctgaaggcaaagactaagagtatataccccagggacggggatcataactatgtacacagcagacactgagcaagcatttagaggagtgcattttaccattagactcttgaaggacgtcatactgaattttcagaattttttatgtacccagggcattttatgtgaacgtatttaccagggagggtcatgctgtgtatgacctttatgtcattctaccaaagaatcaggcaccaagacagctgcagtttctctggctactctgtttccttcttttagggaacttaggacactgggtgattctttaaaaaaataataacgaattaactttttgaattgacaaagatggtatacatttatcatgtacaacatgacgttttgaaatatgtatatattgtggaatggcgaagtcaggctaattaatacgtgtattatctgatatacatttttgtagtgaaaacacttaaaatctactcttccagtgattttcaagaacatgatacatgtcattaactatagtcaccatgttaaacaaaagatttcttgaaactattcctcctatctaactgaaattttgtatccattcaccaacatctccccaaccctcaccaaccccaatcccaccccagcccctggtaagcaaacttctattccctacttctatgagttcaactatttcagattctacatgtaagtgaaatcacgcagtatttgttcttctgtgtgtggcttatttcactcaacatgacatcctccaggttcatccacagtgttgcagttgacaagaatttatctctttttagggctgaatgacattccattgtagatacagagcatacttctgtccgttttttttttttttttctgtgggggatggagttttgttcttgttgcccaggctggagtgcagtggcgcggtcttggctcactgcaacctctgcctcgtgggttcaagtgattttcctgcctcagactcccaagtagctgggattacacgtgtctcccctcgccgccatcaagcccagctaatttttgtatttttagtggagacgaagtttcaccatgttggcttgcctggtcttgaactcctgacctcaagtgatctgctcacctcagcctcgcaaagtcgtgggattacaggcatgagccacagtgcctggtcatgtccattcatctgtcagtgcacgcttaggttgattccatatcttagctatagtgaataatgctgcagtgaacctgggagtgcagatatcccttcaaaatactgatttcgtttcctttggatatatacacagtagtgggattgctggagcatatggtagttctatttttaattttttaaggaacctccataccatttttttcataatggctgtactaatttgcattcccaccaacagtggggcactgggtgattcttaaagagagtcttcaaggaaaatgcaaaagctctacagtatttgggtggtgagacagaaagtggagaaggatattgtgttctagcacactgcaaacatggttactgaatttgaaattcagaaggaagagaagggatttattttccagctcagaattgcaggtagagcctagctatgagaactcctatttcttacatcatcaaaaaggaggaaggagctggttctcctttgagagatttttgtttgtttcccccatatctccattcatttattcgttcattcaaaactttaaattttaagcttttcctccattgacttgaagtaagtggaaatataacttataaggaaagtggaaaacaaattacattcaccactctgtgcttgctcattacaagtaaaggttacacatctggctggggcagaggtcttcaactgacagttcctaggccttttgtactttgctgtctttttgctgtttcatgttggaattcatcgtcagcactgaagtatctggaaattttgcacagatctttatatttctggcttttcattaaaagttggaagatctgacaaagcttgtccatcatccaatataacagcaatctgttgagctttggtagttgttaaatgttttgggtgtagcctgagtgtttcagttaacctgctttactcattggtgtcagctacttgtcctagacgtaacctttttcatttacatcctttttttttttttttaaatttgagtcacccaacgctaaaggtatttaggttggctattattatttccacttttgatggcattaggtatctctgggctaatgttacatagtaacgtcagatctgggatgtgaacgtggtacctaaattcagaccaagtgatctttccctaactcatatgacctacccatatttggcagagccgttatcttagagcctccaaaaatgcatgtgtgtaatcacacacattttgtaaattttgtaaataagcatgcacatatgttaaaggaagttcagcatcttgagcctctgataataagcccttctgggtaaatgagtgttctgcatcttttccatctttttcatttacgctcttataattacctttaaacacagcatcactggacacagcaaacatatctaggtcaatctgtttgcattttgatggctccgctggataaaatctcttctccactttcttgtttctttggaagaagcagagaccaagacaaaagaacctgtggttcatagtggcttcaccattcacaggtattctcctgggggtcaaatcaacaaatcattctgtcagttctgtggagctattcagaaattcgtgttgatgtcagtggcaacaaggaagagcggagacatgtcaggctttggtttctggttcattttcactctaactgctttgcatggtgttctccggcttgacaacccctcaacctcttccttgtccttagggtaaagtctgagttcccaacgagacttcaggatcaatcctctgcctatctatacatcattgaccttgtcatcacttcctttctaaccatctgcaaaacattaaatgcactctcacctctgagtcatttctggatgtctcctctgtctgaatgctctcatttccagcctcttttcctttttctgttcagctcatttctacatgaccatcttgcctatgctttgacatcacttctccttaccctacttctcaggtggcctagaaacccctactccatcaccacatagtattctgtgtcgatctatggagcctctcgttacttaccttgctgcctccttgtgactgggagttcatgatgggaaggaatcttttccttgtgtctccaacactgagtccaaggtctgcacatgagagctcttgagaaatgcatattggaggatttaatattttgttcgttcattacctgaatctgaagagtctttatataggagctctcttgtatctagaaaggggactattacagtgtgagacagcaaaggaagaattgccttgaaaatacgttatggtgttagcagggatggaaagtgtaaatcctcctaacatgtttttgagagtttacttcactttgggcattgtgttgttgtgctaagaatgccctttacttccacctgttattttaattctcacatcaaccctgtgacccccttgtttgtcaatgagaagaccaatgagaaaagaaatgaaatagtttgcctgaaatcacacagttcattgttggagaaacaaggatcccagaaggagctgtttggcagcaaggactcatagtattaaccactccataaagaaattcttgactcatttgcctttagcccttttcttggattactaattcagcaggaagaccaaccctgggctccttaggttaatcgggtttattggattatctagcacatttcttagattatccaagctggaatctccattgccaagatatcactggcctgattaaacaagctgcggtctctaaagactccaaatgtcatgttcctgtctctctctctctctttttttttatcaatatatgcccattttaggtgttattttattatttctctaactgtaccaactcatcattgtgttccaaaggacctcccaggtatataatcctctctgttgctacttaaaagaggaaaaatttttcttttcaatcctgtcttctgattggaggtgaaagccattcaaatctaagttagaaagacattcacaagccatttttgcaattgttattatcctaaaactaaattataggcattacgtctctgaagcattattgctcatacctagaagggtgctttatgttgtatttcatacaatgatgaacaagaagaaaaagactggaagtttagaatgagtgattttggtctgaaataggtatgaatttttcaagaatgtggtcactgcattttgtaccatcatttctctagacatttcaaatttcaattcactcattaatggctcaaccgttaataagaaggtgttttccacagttttcttgagttttatttgctgttgtgtcctgagtgtgcataattttggaactttataacagtagtgtttttaatattttattcataatattaacgttagctgttatttagggagtatccccaatgtgccaaaaataaccccatctccgatctttgcaacactgttgaaaaatagaaagatagtttctattttagacaatgaggctgagggtagagatatgacttgcttagtgataaacagctggttaaagcctgagacttaataggaaccaaaaattgcctgaccttaaactctgtgctatttccattctatcacactgctgtggaaactttgagtacaaaaagatttcgttaaaaggatgttaattgcagagttgtaataatagtgactacttggtaacaatataagtatccactgataggggattggtttaataacattttgttatatccacataatgcaacattatttaatgtttaaacatgcactttaaaaataagtgaatatgtattgccatggcaagatgtccagcttatatttagtgtaaaagagattgaaaaagaatttgcaccacattatctatttttaaagcatgtttatatttgtgcatgcatgggcgtatccctaagcaaggtctggaccagcactgttcagtagaaatataatgcaagtcacatatgcaaagtaatttttttagtggttgaattaaaaaaataaatgcatgaaatgtttgttttaataaattttacttaatatatccaacatatttcaatatataatcaatatagaaatattaacaatatattttacatttttttgtgctaaatcttcaatgtacatttttatactgacagcacgtctcatttcagatcagtcacatttcatgtgttcaatagccacatatggctttccgttaccttattggatagcactagtctagaggaaatataataagatcataaagtgttcactttgggatggggtgattatgtgtgttggtgttagtttattgtctccttttgtcttatttgcatttcccaaatttccataatgaatacatactgcctttgtaatttggaattaaaatacactgttaaagtcatcattcatttttaatagggagtggtgagcttctaaaatgcactgttaaaaataaatacatagaatgtaaatccgtgacctattttcagtcgaggcgagaagctggagatggtatgaggttggctctcctctttactcccttgccttccagctctgtaacccctgctcccaaaagccaggcctctggggttctgatgaggggagaggttaagcctcacctccacagtcagcgagcagatctctgatgaagccaccattcctaccagaagttctgaggtttggcctcagattcattttcaatctctttgaaagacaaaggcggctgtcatgggagaagcctacactagtttgtctcaatcttttatggcattattgctgacctttcaccaaggagcctttttagaccttttttcccttcctaatcaccattccccttccctcattaaattttaataccacacatacactgtatgtctgtttataccatgtaaactgtgtgtgcgttgatgtatggtggccttctggatggccacaaaccaaagtcatatctaaaatttcttaccctcttgtaactaagaatccatttccacccctttagggtaaataatcgctccctgtctcattgagaaggacgcccagggccatgttcactggtgccaaatgtcagtaatacggttgtcctgtgagttgcatttaacttcgaatcttggaccagtcaccagctctctcaccgttctacgcacacatctttgcctttgtggatacctgtcacttccctatccccactagggcatctgaaagtccatcacacccgggaaacctacccaagtctctctccctgaccacatgggaaacagcctttctgtttctcctgtggcatgtgtcatggctggcattctctgttactcgttctgatcctgtctcctctccccctctgatccgaccctcctggagaatgggatgctgtataatttcatttcccgtgtgtgtctagagccgggctttgcatgccatcgtccttcagtgaacagttgtgaaactgaacgaaattgccttcggaaaaccctttccggtccaactgtttctctatcagaaaatctcattaagacttaatcgctaacatcttcccatccccggggtcatgctgtaatccccagctgagagtgcgatccctgactgggaggaagtgagagtatcatttctttcccagaacccacacgcttcctgtgtatttcccaccacccaaaggtcaccacctggggtaaaattacatgcaacctcatgagacttgctgcccctctatcttccctcttttatttctgaagtcactgtagggaaaatgtactgattgcaaactgaaatagcagccactgggagctggactggtatggctgtcagccataccccccgggtttcacctgcttaatgagccggtagcccatgctttatccagtagagacctcactgtctcccattccagcccaccgttgcccacccttgcttatccacacctaccaagagccccttcccgagaactgctcttccaaagtgagattgtactcccaaccctcctctgtagccatccttgggtccagtgtttatttctttgtggccaggaaatctctcccttgctctgttctgcatagatgttgcctgtgttagaatttcagtagaactctgcagatttgaatggaagatttgagggctgcaagagctatcatcgttgatagcaagcatttagctaaggaaattaaattggaagtccttgcattctggctggattctgttactctttgggcagggaatgatttggtttcaaggagattccatcttcgtatctcctgctttcaagggaggaaagggggaaagaaagctgaacagagcctaatgaaggaattctgtatcgacacaactctgacatttgagatgttcaatgtaatcagcacaactggtagctttaggcattgatcactgtgctgaaatataaaattcagttggccatattctgttcatgaaaatgccttttcataattcactgcttccagaggtaccagcgataatttcttgactattttattctggagagctttaggtatggttaacaatgtgccatgtacagagaggcatgtatgcacaccataaagatcttaaatgcattttcagttcagtgtccttcttattaattattctagtcactttaatttattcagcctccgtattttatacattaaaatgagtgaaaatgataagaaatattaatggttgtaattattgactgtatatttgagattcatgtctaaatacacttaacttgggaagatttgacattctgtttcactgtgtgcattatttgcctgtttcatcttctatattctcctaaaccctctctctctctctgtcaaggggggaggcgaattactgcaagtagattatgaaatattgttgtacatgcacgtaaaaatatatcagtactggcacatctgtaatttactcataagtatgagattcatattagagatctatatatcatataagcaaaataatatccatcctgtactatattattttactaacatgatggctgaatttcaaatgaactgcaaaggtcatggttgctgttctattagagccatttaatctcatttgtctccccattactaacctcaactttattagttgctgcaactactgctgattttgaaccgagaaagggttcctctaactgatgtcatttcatgctttgaatttacaagtaagagaccctgatttaaaattattagggctcctgggaaaggagaacattaaaagtttgcagtggtcctctggtttcccataaggtgaagtttttagatggaagaaagatgggtcctgtttcacctatgacatattgcatacctttccaagcccttgtattccctcacctcttgcccctcttcaaactagtgatcacgtctacctttgagaaaactagtagctaaaatgaaacaaagctactttatgaaaagtccatgagaagcaatttaacctggttgaccatctccatcaatctgtcacctggagagaagctgttgacaccacatgacctctcctccaccatcacgctatgaagttatcacttgagtaagggctttctctttgatgctatacaattaaactgaaggaaggaaggctttcgctagtaggaaagcaactgcaaagagaggcttaaaccctatggaaacaccttcccctctcaggcacacacatgcaaattatctttaaccaaaagcgaatgggttccagtcgttcagcacacatcacatataagatattcctagggcaggaactttttttttaatgagtgagacccctgtagagttcatgccattgcataaaatattgcagccatttgcatttaatggtgatacaaatactgctttgaacactgggaacatcatttactgagagaaacaggagatagtcagtataaatctccaatgtaaaaaaaaaaaggattaagataaaaagtagtttaaactccaacactttctctgtattttttattatttctaataaacaagcctatagcttttgaaattttatcactaacttgagaggtgactgttttctgatgtttatacatcactcacttagtcatgaacttgtagtaacaatgccacatgctttatcaatagctggtgagttaattgggagggagggaaatgttttcttaaaaaactaccttttctccagaaaggataattttatgtgtgtgtaataagaatctagtatacctggtgtattaggtgcttaatatattgtaggcccttggtaaataattctgggataaatgaatgcctgccaatttatactgtcattatccctcccctccctgatttagtaatttcaggctcaagtagttgatcccaatgcttttgtgcaatgtgtggcttgtcttttgtcattgtttataagctccataagaacagagactgtctattcactgttttgtttctgtaaatatataaccatatattgtgtatatggatccttaagcatgaaggcttagaggagataatgaataacacttttatacagaaatcaaaccaagactttcatatcattatggaatcacatgcttttagcgtaattaaagttgttgcatatagaacaaataagactgcattttctttagctgttaacttggacttgccagatatccagacatgcttcacttttggtttgaattaacaggtgaaataatacagtgtgtgttttgttaaaattttattaaacgccgctcttaaaaattaagcaagaaaatgaaagaaagaaacaaaaacaattaaccaaagatcacccacaaagctcccaaactgttttgttctgggtgctaaggcactgtttgattttttttttcgtgcatattgatgtactctttccccgttaactgcttctagtctccctggacctccaaggctgcatcttcagggaataactcatcgcatctccattatgtgtcatgtagagacgctatgtaggtaagataacagagtctggctaaagggcacgtttggtgttatattccattagtttattgatttttttttaagtttctctaatgttctaatgagaatattttccactcaatcctgaaggagtccaaagctttttacgaacttcaggatagaacacacagggactgattccctaggctgccgaacagcagggtccttggaaagaccaaatggaaaattgcttttctatgaaccccaggtgcaagagttagggaacccctatctaattaagagctgggggagttctgatgcagtcactggggttggacccatcattacggtgaatgctaggctctggccaaacacctacagccccttcaagggtcaagaaagttcatggcaaaagatttgagtcacttcaggggatggtggaagtttctcccaagcctaccttggcgtctatgactccacctgaaaaatggcccaaaatggacaataaaggaatttggagggacaatggcatcaagtcaggacttcctctgtaggacacatatccaaagagccaacccactagagctccagccgcagttcttgcttgttttggctgtgtgaatttgggtaagtcacttagcttctctgagccttagctttcaactttgtagaatagttctgagcattaaaggagacagtatatgatgtataaagtggaattgatgaatggcaggttctcaataaaagttggcttgtggttatatcattatcatcactactactgtcatgatgtccagacatcaaggcagcagaatgtgtcctccatgtgttaacctggggcccagcctctatttggtgcctaatagttaaaagttggatgcttgttgagtaagtgagtgtatgagtcccttgtcgtctccctgccaaagggaacacttgatcagcataggagataactaacggcagtaactttgctctgagctcttgcttcttcatcaaaccgtgctttaaagacttccctgtgcagaggcagtatagaatgaggctcaggaactcaggctctgtaggctctctccactcacctctttatgtgtctgacaggatgccagtccaagcatccttttccttattgataaaaataggcatcatgataataatagtatctacctgataggatggtgaggacaacaaagtgagatcacgagagcctgacactaagaatcccctggagagctttgaaagcattactgatatccagaccctctccccaaagtcttggattcatttgttcaggaggcaaggttcctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgccattttatggttgctgttgttaaatcattctaatattctgtcttttcctgattgcccatttctctattttttttttcatattaatgggaaaaccaatcatgtacttttttgaaagtttcactttgttttccttttgctgggtgtaccatttctggaaaatacggcactgaaaaattgcaataagtgaaaggtaaataactggatatatgtctatagatgtggatctatgtattaaaatttaggagatcagagttattcctactgcaatgagccacatttgcaggcatgcatagcaccccactttgtggggcacccattgctcctcattctgggtccagctttgattccctgtggctgctgcagtctctggctcatctctgcagctttgatagctgtctcaaatacaatctgcaatctatcaaggagggcgtggaggtgtcctgaataatcagcaggtgtcttggttatcaccaaggagagggcatcatgcccggcatgcatggatggcagaagagttactgcaaaggcagttgtaagctcaggaatccaattctttttctaagttagtgctgaaatgtggctgactcagatgtggggtgtcaggatcatagataggacaagagagaaaacttgtgttcttatttgaaagccacagcctgtgtggagaggcctgcagttcattgccactggacaagagagtaaaatttctgggacctccacttactctaggaagtgttagagggtgataggaaaggagtttgtgcagacttctgcagcctctgcaggtggaatgactgttctctcctctagtctcttagagtctgtccacaacctctgaatagcccttattccttggtgagtcactcagcaaatgagaaattaaatgctattgtgcatgctttatattatgtgtatttcttctctgttacattctaagccacttgatggcagagccgtgagttactttgctcaggatattcagcaccaggaaggtactaggcacacatccttagtacccaggaagcacaggggagttgaagatgctttgaaagacctgtttggcccttcaggtagacatgcatgggccctgagaagccccagaatttcgatgttctcaggaatcatcaggagactagaagacattgattctcaaccctggctgggtagcagggctccttggagagttttaactagtcttgatgcctggatcccagaagagaccaatttaaaccagtgtctctggatttggagccagagtacctacagtattgtagttccttaggtgctttgggttcaggcagggctgaggaccacagctccataataaaaggatggctgagctaaaaggggtgataagaggtagaaagaggctgggaacggtggctcacacctgtaatcccagcacagagaggccgaggcaggtggattacatgaggtcaggagttcgagaccagcctggctaacatggtgaaaccccatctctactaaaaatacaaaaattagctgggtgtggtggcacgtgcctgtaatcccagctgctcaagaggtaggctgaggcgggagaatcgcttgaacccagaaggcggaggttgtggtgagctgagattgcaccattgcactccagcctgggcaacaagagcaaaactcagtctcaaaatatatatatataaattaaaaaaaaaaaaaaaacaagtagaaggaaggagtgatacaactgaaaggagaaacaaaacacagaaagatcttggcggttttgttacatcttcagccccatcaaaccaacacccttcaagctagacactttgcttttagcattttgtcattgttaccctgtttcttactcacagtgatcttaaacaaaatgactaccctctttgtagcaaaggaaaggaagcttataaactgatgtgctaggctcctggactccagacctcaagcacttagccagtaaactgtgttccttcaaaaagacaaggtaaatatgaaggaaaaagggagtgaactggacagaagaaaaaacaaaattggtaaactcaaggaaagctgataggcactaaagcaaaaacaaatgagcagaattcatagttgttgagggcctccaagatcttatgagaaactcagaaggtgcaaagcagacccagtcatctccagcttacaacagatctgggatggctcacagtagtccagtgtcttgctcaaactcacaaagctaagtctctgagctagtttttctgtaagggccaaaagctaagtatgttagtctttgctgaccacgtagtctctgccacaagtattgaaatctggtattgtggcagaaagtggccacagatagataacatgcaaagaaataaatgtagttgtattacaataaaatttgatttatggacactggaatttgcatttcatgtaattttcaggtgtcatgcaatcttatttttctttggatttttctcaacttttttttttaaaaaaatgtaatcaaccattcttagctcttggctatatcaaaatagatagtggggcacatttggcccttaggctgtcatttgccagccctggtccaaactttaaagtacccagagggtaaaaagttgatgagaaagcatagaaaaaaattgatacatgactatttgagacatttacccccagtccaccttcccacagaaagatccatcaggccaagagtccaacactttccatcttccatgactcaatgccaccaagcagttatttgtagaatccatttgcggttttcaaaccataggctctggacttcaaagcaggccagtcccattctttttgtcttgaaatgagtataataagctcccagaccctttgttctagcaatatttattgaattactaataaagactagactctgttctgcgcactaagggtgcagtggttatcttagtctatccagttgccatagcaaagtgccatagacagggtggcttagacaacagaaatcttttctcttgcagatctggatactggaagtgagatcagggtagtaggatggtctagttatcatgtggtctcggtggcttatggatggtggccttctccctgtatcttcccttggcagagagaaagagagagagggagaggaaagaagtgggtgtggagggaagatgtcttttctttctttttctttatgttttcttttcttttctttcctttattcatttatttatttgtttatttatttgtttattttagatgtagtcttgctctgtcacccaggctggagtgcagtggcacgatctcagctcactgtaacctccgcctcccgtgttgaagcgattctcctgcctcagcctcccgagtagctaggattacaggcacccaccaccacgcctggctaatttttgtatttttagtagagacgagtcttcgccatattggccaggccggtctgaaactcctgacctcaggtgatccgcctgccttagcctcccagtgtgctgggattataggcgtgagccaccatgcctggccaggtgtcttttctgataaggacactaatcccatcaggagggattacctttgatatagtttggatatttgtccccactcaaatctcatgttgaaatataactcccaatgctggaggtggggcctggtaagagctgtttagatcatgggaatgggttcttccttgcttggtgctgtcttcacgacagtgagtgagttatgagatctggtgggtttttgttttttttttttttttttttttttttctgagagggagtcttgctgtgttgcccaggctggagtgcagtggcgctatcttggctcactgcaagctccgcctcccaggttcacgccattctcctgcctcagcctcccaagtagctgggactacaggcgctcgccaatacacctggctaattttttatattttttagtacagacggggtttcactgtgttacccaagatagtgtggatctcctgacctcgtgacccggccgcctcggcctcccaaagtgctgggattacaggtgtgagccaccgtgcccggccggtagagatgtggtgattttaaagtgtgtggcaccttcccccacgctctcgccctcttgctcctgctttggtcacgtgatgcttctgctctttcctcactttccgccatgacgaaagtcccctgaggcttcgctggaagcccagcagatgcctgcgccatgtttgctataaagccagtggaactgtgagtcaattaaacctcttttgtttataaattactcagtctctggtatttctttacagcaatgcaagaacaacctattacacctcatgccctcatctaaatctaatcacctcaccaaagctctatctctgaataccatcgcgttggaggttagggcttccgcatatgaatttggagggcacacttcactccgtaacaatggtatacaaaataatgaggtttctgtgttcatgagcttacattctttatatttgacaataaaaaagtaagcaaaaagtaagaatttttagctaatgttaaatgctacaaagggaaaaaaaataagaaaacatgtaccgattacagagatgaactgggacaggaattacaagtttggaaactgttttcagggaaggcctgtttgagcaggtgacttaggactgggggtgagtggtgtggaagcactcctggaggttgctggggggagactggaagactgagcaatagggagagagaagatcatgttcaaaagggccactgagaccaaaaagctccccaaaacaaaaacaaggttcaaaagggtgagccagcggggtagacaggaggccagcatacctgaggagagtcgaagtgggggacagtagctcccactgtggagagtttgagtgttacctattaaatgcaatggggagctgggcacagtgtggcttatgcactttgggaggccgaggtaggcaggttgcttgaggtcaggtgtttgagaccagcctggccaacatggcaaaaccctgtctctactaaaaatacaaaaatttagctgggcacggtggctcatgcctgtaatgcgagcactttcggaggccaaagggggcggatcacttgaggtcggcagttggagaccagcctgggcaacatggcaaaaccccgtctctactaaaaatataaaaaattagtcagatgtggtggtgtgcacctgcaatcccagttacttgagaggctgaggcaagagaatcacttgaacctagtaggtggaggttgcagcgagccaaggttgcactactgcattccagcctgggcaacagagtgagactctatctcgacaaaaaatttaaaaaaataataaaataaaatgggaagccgagcacgatggctcatgtctgtaatcgtagtactttgggaggctgaggtgggcggatcacttgaggtcaggagttcgagaccagcctggccaacatggcaaaaccccatctttactaaaaatacaaaaaattaactggttgtgatagtgcgtgcctgtagtcccagctacttgggaggctgaggtgggagaatttctggaacctgggaggcggaggctgcagtgacctgagattgtgccactgcactccagccggggcaacagagtgagaccctgtctcaaaaattaattaattaaaccttcaatgaggaggttttgttgagtcagaagcacttcagtacagtcatgcagcacttaatggcaggggtaccgctctgagaaacaaatcgttaggcaatcttgtcattgtgcaaacatcagagtgtactcacacaaacccagatgctgtagcctacgacacatctaggctaggtgatctagcttattgcatctaggctacaaagctagcaggttagtgtgctgaatatggtaggcatgtgtaacatcatggccagtgtccctgcacctcaatatagctaaccatagaaaaggtactgtaaaaatactgcattaacgtcttatgggactgctgtcctgtaggcagcctgtagttactgaactgaaatgtggttaagctgtgtaggactgtgtttgcattttcaaaatattttgggtgctattcagggaacggacagtagggggcaaaagtggaagtggagaaaccaaggaacaggctgctgaagaagtccaggcagccttggaggactcgctctcactcttactggttttcgatgcctgagttacttgctctctgggagaaggaagcaggtcgttcctctgcccaaattgctgctactcaggagtgcctgacactcctttccaaagatgctctgcggtaatatgttctaatgaggagtttgaattgccaattgacttgctctttgcagctaataaagaacagattatgcgctggatggtttgcagttggtggccaagttgtcttgtgattattgtaagttcttttagttgagcttgtgtaactgtgagtcaatcctgcccatgttttatttggaaattagtactagagcctccttgggactagcctttttctcacccaaaggcaaaagaatccatctcggctgggcacagtggctcacgcctgtaatcacagcactttgggaggccgaggtgggtggggcggatcacgaggtcaggagttcgataccagtttcaccaacatggtgaaaccccatctctactaaaaatacaaaaattagccaagcgtggtggcaaatgcctgcaatcccagctactcaggagcctgaggcaggagaaccgcttgaaccctgaaggcagagtttgcagtgagccgagatcacgccagtgcactccagcttgggcgacagagtgagactccatcttccatctcaaaaaaaaaaaaaaaaaaaaaaaaaaagaatcagcctctggatcacattaaccctcacagcccatagtccttcgtcttcctctgaaaaaatatgaaatattaaagattcttaaaccaatgagcagtttccggttattccagaatatacagcacgttggtgacttgttccacattttctttttctcttctcagtgcttcctgctagacatagacacatacacacacctacaccccttttaacccattttaaataattctgtttagaaaagcaacatatgatcatttaaaaatattgagaaacacatacaaaagcaaaaatcatccattagctgctcatcacccccaaataatcactttttaaaaacattttgatatttctctttttggggtctctgtgtgtgtgtatgtgtgtttgtgggacagagagagagagaggcagacagaggaaaaaagcttacagtatttgactgatagtgaatttttagaatttatcgtataattttttacttggtattaaaatgtgaacattttaccatgccatgaatcattttgggaaattacatgtaatgattccataatgttctgttgtaccaaaagttattacctctgttgttattgaagaaattttttatctttctcccttactattattaagaataatgtcacagagaattttcttatactcaagtctttgtttacatttttgaatatttccttggactaaatgctaaaaagtattgtgtcagggtcggaagatatgagcatctttatactttgtgaatagattttatgttgctttttgaactggttgtgcccctgcacatcccataaccatagcgtattagcataccgtttaatctagtcattaccaacattatttggtattattacatactttattaatttgataggtaaaaattggtattgccctgtttaaaccttccccttttcatcttgtctgtttcgtaatgccaagagtaaacacatatcatgctcttaacacaatgtgaaatactgtggaaagtagatactactgtcctcattttacaaattgagaagctaatacttctcgttgagaggtggagctaagatgggaacccagtgtaggcaatgggaaccttgagtctgagccttagccagggctctgttccgcccccaggcaggagcaggaacctgagaggaccttctcagttaggtgtgaaataggaaagcagcctcattgaagtaattcacactaacatgtgaatgacctggaagcatctgtctggtttttatgaaaaaccaaacagaattacttgttatttcagataagcttctcctttgtggatggaaatgtaagaagtttaacgcaagtaaaaaaaacatctaacaatgataaaggaagataccatcgggcagattcagaccttatggaaatgtaagaagtttaacgcatgtaagaacacctaacaatgataagggaaggtaccattgggcagtttcagaccttcttgcaatgcagtggtggctcactgctggcccacagactagaatcatatttattcctatgagataaaagaaaataggtcttaaaattcagtgtttaaaatactaaatcagttgctattagacaaacctctactattctaccttctctttaaaaatggaagctctggaaacattcactactgtttctttcagtaattgactgcatctgattaatcccactgatgcttcaccttgcatctgttagctggctagctctcttcttccttccctatcaactttccccgctttctccctttctgagccaactctctaaaacttttctttttgataagaatattatattttaatgaaaatcctttctgtcatggagaatcccctttccatcatggttaggaatggagacttaggggttacggtggggctgggtgctgagtcatttggaagacacacatgtgcaagttggggcctgtgtctttattagccctgcttaaattgctgggtaatttaagcctctcttattttgctgcattgcctcacagttctaaaggagacctgaaatagagtgtatcacattgtgcacatttttgaaggatcatgagagcagcctaaatataaaattcacgtccatattcttagtgtccttttcccctaaatggagacgggatgcacttgagcattctgtcccatgcttgcctttgtctacacgtgtttcctaatgtttgatctctgtcctttttgtatgtgagaacattcacaggcatcttcctagctgcaaaaagacgggcctgggttgcaacaactggatctttgttatttcttggggggagctcgtatcaaactctccccaatccatgtagtgatttttttctacatctaaaaatgatcctttaaagtttcaatgatgccttggtgacccaggaccactgttgtaatttttgccagtttctttgtatcacttggttgatcttgtattaaatgtctaattgatttgtttttttaaagatacgtgcatgttagtataataactagaagctcgatgttatgagttgaagcataattatgcaagcaacttaatactaaacttagaagatacgtgactactaaccaagaccatctgatgtaccattgatggctcaaatgccagatgtcgggaaacagtgatttaaaaggaaatatttcatgggggtcagcataaagtcggtcctgcttctagaaagccacagtagttctctgtatccatagctaagggtctcttaggctcttattgtaaatgtctgggtttcactcaggaaaaaaaaaaaatctcaaagctatggccaaggcagaggcttcctcacagcccatcccctgtgcatatcgattagttgacatccatgagtgccccagtcctgctggaaatatcccctcaggcttgcttttctgtggtatcaccacctattcccctcttgttactcggacctctttgaagtcatcatagtgtttttgggaatagagaataccactttgcagagagagtgatagcggcttgtgatcatatcctcttcatatccccattgtcggcgtttgtaagaccccaaatgctcctgaaaacttgatttctaatggttatgcaatatttaaatgttaatagattactctttgcttgaccatttccctattttattttttttgagaaagagtctcgctctgtcatccagagctggagtgcattggtatcacctcggctcactgcaacctccacctccctggttcaagtgattgtcctgcctcggcctcccaagtagctgggattacaggcgcccaccactacacccagctagtttttgtatttttagtagagactgtgttccgccatgttggccaggttgggcttgaattcctgacctcagtgatccacctgcctcagtatcccaaaaggctggaattacaggcatcagccaccatgcctggcacccgtttccctagtttagacatatatgttgcttcttattctgcatcattcattcattcatcaaatatttataggcaactatcacttgccaggttgtagagaggacaggaaagcagtgctgagcagccaggcctctggatccttcttctccatcaatctgtgaatttttacttatatctgagaagggggagggatggaaggagggaaacaagggagaggagagaggaagggaggaaacagacgcagctgagagctcctgaagctcctgaaacctctgaggagcattctcttgctttgtattcttttcacagaaccagtgactcttgttttcttttaaaatcctctcctccctcccctccctcccttcccttcttcccttccgttcttcccttccttccctcctttcttccttccctcctttcttcctccctcccctccctccttcctccctcacttccttccctgctttcttccttttccttccttctttccttccgtccctccctctctcccttccttcctcccttcctttctgccttccttccttttctttccttcccctcccttccctccctccttccctccctccttccatccttccgctctccctccctccctttcctccttccctctctccctccctttcctccttccctgcttccttctttctccttccttctttcctctctccctcccttccttcctcccttccttcctccctcccttccttccttccttccttccttccttccttccttccttccttccttccttccttcctccctttctctttttctcatctatgagccagaatgttacgctaagttttggaaacagcactctctgctgtgtctttaggatgcttgtttcctgcatgctgaccagacctcctgttggactgatattctggataatggcttggtgcctttctagcttctaatctaaacaagaattatttcattttagattctctctgctgcatcaagggtccctggaatttgatgatgacttaagtggaaatcccagctttagcatatataagctcagtaccatagaccaagtgggttaacctctttgtgccttcattttttcaatggaaaagttgcaaacaagatacttacctcccaggattttcctgacaatgaatgagaaaatgtaagagaaactgcctttcgaattgggaagctctattctgatgaaagatggaccttatttttaaatacaggacgtttagtaattttatctaaattccccattcatcagaatacagtggagaagatatttgccatacccatttcattgtgttgttcataaacttgtttatttttccagggctggattggtttgcctttctctctttctgtctgctactgcataatttcattatctgccatacgtaaatgtattatgtaattctctcagttgtcattgattgcttctgtttttctgtagtattactggtctataatactttttattaaatccccaaggatagttcctgaactgtggttgaaggaccctcctttccactaagtaaaatacaacacttagatatttgaaatgacacaaagtactagagaaaacataagtgtggaattttcccactggctttatgaaatccaggaaaccaattgagatatttgtttatgatgcctttgtctatcctggaggtttctctctgcgttctttcaatggcagtcacagcatcaacaaattatataaaattagctaatgtttattgagtgcttactatgttccgagtaatgttaggaactgcttgcattgtcatttaatcgtcacaacagcctcataaaggaggtacgctttgttatccccattttattcttgagagaactgaaattcagaaagtttaactgctttgctcagagatacacaataaagaagagatgaaactgtaaagcacacccctctcacacacacaccacacacacatacacaactttatgcaagcttagcaaagtcagtttccttcttagcttggagaatacatacatatgttgaatgcctgagagtttgggacttctctgctctgtacttgcttctgacactaaccttaaactaatcacttctctctggaactaggtctacttatgggccacgtttgaagggttggatgaggtcattagtttttatttatttatttatttatttatttgagatagagcattaggttttttttactttttattttatttttttgaggcaaggtctcatcctgtcacccaagctgcagtgcagtaagacaatcttagctcacatcaatctctgccttccaggttccagtgattctcatggctcagcctcctgagtatctggaattacaggtgtgtgccaccacacctggctgatttttatatttttagtagagagtggattttgccatgttagccaggctgtctcgagctcttggcctgaagtgacctgcctgcctcggcctcccaaagtgctggaattagaggtgtgagtcactgcacctgcccaaaagcattagcttctaattgacctcatgatgttcaagaatctgagcaggtggtcgaagggtggtggagaggataggaaggcagtgctgagcgggcagggttctggatccttcttgtccatctgtctctgagcttttgcttatatctgagagggatagagggagggaaagagagaaagaagggatagagggagagaggaagggagaaaacagacaatcgacatcacatgctacactactaactcattcaaaaatagcattgtgccattgctatttcccatgtatgtcattagatattccatgaaaacttgatttctaatcgttatataatattcaaatgtgttaataggttaccctctgcttaaccatttccctgttttagacatgtgtgttgcttctgatacttcatcattcattcatttatcaaatatttatcagcaatgatgattctccagacattaacataagtaagtagggtgtggattttcttatatataaatttttgacatgcctgcatatatgtgcttccataactatatagaatttggtatttttgctcttgctgctaattgctggacttctttagtgaaagattacctgttctggaaagcctgctaatttagatggtaggttggattgaaatctgtgcaaatgatgagcttatctgtttcggggaacataattggagttctggacacactctctcccaggattataggtatgagattaataggcattgttttgatggcatatgccacaagcatcaaaatatccactttgtgaccttcaggcttaaagggatcatcttgaaggtatagctttacatgttgcctagtttagaggtagatgaggctgtagataatgtccactccaacctgtgcagaaggatctgagaggcagccccaggggttgctgtaagacttggtgttgctgactccccttagaagtaatctccaaacaccaccaccaccaccacgaagtgtgtcatcatataaactgaagatagctgagattacacactgcctaaatttcactcagaaaaacatgatagagatcatttctgattgaaaaggcaataaagaaactcctaaacatacctctttgtccataaatggaaaccagacaaatcaggcttgtagatttaaagagaccctgcaaggtggcgattctgaaataccccttggaaggaccatgccaagtctgaagtgaagctgcagagtgaagcagtatccagagactgagctatttctggctgcagactttgtgtcatgaaatggtgataatttccccacgccccataatgttcctctccttcctgatggctctataagtttgagtgatgtcagtctgtttggaggcagctaggtttgcttgtgtcttaggacagatgtccagaaaaaacaaggctagaccctgaagagcctggacatccattagaatgacaaaagactctgtggatacaaaataccattagtttttcttccttcctctatattctctctttttatctccttccctgatagcaagcaaagggtagggaaatctaagtaggaggcttctatccttgactgatttttttttaaatttttctgcctcctaggggatcacttaattcattttatgcctctggaagagaccagaatttcctcactcctccaaattcctgggcaggttacctctcccaacctcagttcatcattattctgcactgagttatgtaatgatttgatcgtgttgaggagtaattcacctttgttcccacctacgttaagactgattacaaatcctcataaaatactgattatgctaccaaaaatgttcttaaggatagtctgttaggaaggaggtaatgctgctgctcagaagtgtgggcttctgtctaattatgtgtaaattatctgagtggaatctcaaatgtttagtgataaacagtttgatgcgtcccagcaaagtatctagtttgtgaggcaatataatcaaaagcagcttatgtgcagcaaatcgtagatggtataactttgcgtctttttcaagttatttttacagaaagaaatgagaatttgtctgcagccctttaagaatagcaaacgttgtattttgcattttttaaagaaagataattgatcctttgactatactgctgttctgttctcagaagaaacattaaaaagttggatttcttaagaaatgcaattaaccgacttttatttaatgattttttttcacgttattcatcctggaggaatggtttctgttggttattatcaaagatgaggatggattttcagaagcaaaatatcatgatattctactgcaatgcatctgtggttactcagggaagatccaatgtggtttgtatgtagatatctccttctttagaaaacctttcctgaattgcctacctccatctcccacccatctccagctggaatgttgtacattctctgtgccaccagaagaaagctattctaataatcaaagcgaataggacaccatttaattgggatgaagccacaattgttagtgtagctagtggtaattgaacctagatgttcataatctaggatcctaaactagatgttctgataatctagatcttcataaaatacaggtatttaagtctgaaagctcattatttcttagtctcagtggtagggttccttaaaggcccaagaagcttgagagaagtctaccagggcggatacccatcgaaaaatcaaagccaaggacttctataggcacagaatggtcaagatatttattcagcatagcatgaggaagtttagtccagtatagaaaacaggaatatcagttaaaatgaaattagcatattagttaacataagaattcccacgtcagtgtttgagaacactttgcagctcttctagagacattcttattacagaagaagatgactaactcagaagaaaaagggtatgaaagtctagtaggagaaaatgattagcaaaaaaaaaaaaaaggtactaagacattaatattttattgaaaagaggcaagaattctgtcagttccttattggtggtcaatgcagaataatgctagcattgcctatcattcagttgattccgtaggcggctaaattggttgcttaatgaatccatagtggtatttggctccgcttggtttccaaaattgtaaggtaaattctgtgcacgtggttttaagttggaaatggttgatatggttatacttggtgtatgcattcaacaaattaaccagttgcaaatgtgtgcctattcacaaaccccttgattgaattgcaagtataccagctaattagacatgtgttccgtaatgcttaaagagagatcaaacctccttcagtgtctctagatggtgaagtcttaaatttacccaagatcaaaatatctacataaagattcctatgtatatctgacatgtgcaagccagagggtgttggacattttgaaggccaaccatttagatgattgactaaatatatttactttcatcatacagatctgtccaatattaccagcataccttttaagaaagtgtattcatccttttagagttcattaaaatttatcatgactgtctgtgggatgcatttatttcatattgacttctgtttgtatcctttcctatcctacattctctataaccagtctttttgcaagtctgcaattcatatcaaaaagtctgaaggaattttatttttatttccttttcagtgaaaacatattacaaattgccaactcatgatgtattcagtttgaacttaaaatatcatttgtttaaaaaatgcaataaaacctgatatgtacactgatattcattctgaagattaaagctgccaatgaattatggagctgggccaaggctgtcttgttctcagcctaaatttatcttgtcgaaagggaattattctgaccggggctagagagtgaagatagttaaaatttgattgttcgattgctttcttctggcttttttttccttcttaaaaaatatttgattatatttctcttaagagctggattttaaaatctaaaaactgatgacggatggataaaaagtcctattttatctaattctaaaagtgacgtaggtttctggagactcttttttttttttaatgtacattttctctttccttttctttctttcttttttttttaaacatggatctttggccatgggggaccccatgctgagtgcctaccctctctgacttacacagaggaagcttcagtgtaatagaaataaatgctgcattttctctgtttataacatgtcacttgggcaaagtggtacagtgtctctttggtaaagctgaaatgcggatttctcagaaatgtcttgttttcagttaatgatattttctgcttttcaccaggtggtctctttggggctttgctcttgaattcatttctctgtgcgtaagccaggctttctgttactcgtttattcagccggcatttactgagtcctcaccacactcaggcctgagcgcagcgtccaggttgcagtggccacggaaaccagccctgtcctattggtgcttgctggctttggggtaaagtgacaggctgatactatattatagccagggccacgttagacatcaaaataaaatgttctgggaatagagaggagggatggcctggcatggaggtgagctgggggaatcaggctatctatggtcacatcattctatgaactagcagaccaggcataatgggcgacgtaagctcgccctggtgttgcctgacctgaatgagtgcttctctggaaagagctcatagttcctctttctcttatgtgaaatcccacaaggaaaggcaacttccagaaatggccaagctttctatccctaaagagccagccctcaaggactcatgaaggctgaaagggaaattgatcattggctcattatggtcctgatcaggtatgacctttgagaaaccagtgggcctggtaacaatagggcagccaagttggccatatcagcagatgttgcatttgctgactccatggccagcgccacatcacctgctctgaaggtgtttggttcccgctgcgattggatctgtattcaaaacagattgtgcctgctatggaaagagagccagcttctgaatcctggctgagtttgacttcgttgaccacagagtcttggttctttgcaaacgcaaaggaaaacacgatgtacaccttgactaaattcagctgttttcctcatccattcagccttgccttcattgcaaaatgagcaagcttgtgtttcagagggcttaggtcacttccccagcttcacttagatctgggtgttctgccttccagaatagagtccttcttctccctccatagaccctaagactattaacagtaggtcatccccaacctgttggttaagaaagacatgcacagtatctgcacaatgtccaagggatccccaggatcacctcacctttgtccaaagagaataataaggtgttggtagataagagggaggcccatgtgcctctgccattaggtcctgtgacagggagtccacatggagatcatcatgtgataaagaccactagggctgtagtccagggacaagcttgagtgacatctcagtggggccgctaccttcggagagctccgcacataaggacagagtggctggggcagtcaactggcatcctagaacatatttctcaagaggggccctgctgacgttttggaccagattgatagttcattgatatgagttttatccattgtaggatgtttggcaaaatccctggcctttccccatgagacactagtaacaccctttcctctgggagtcaaaacattgtccagtatcccctggggtgcaaaatcacccactgcttgagaaccgctatcctatggccatatttgtactcactaaagaaagggtacataatggcagctactctgggcctcttgaatcaattgcatgtgattccctacctacctccctccctccctccctccctccctccctccctccttccttccttccttccttccttccttccgagacagagtgagtctccttcacccaggctgaagtgcagtggcacagtcttggctcactgcaacctctgcctcctgggttcaagcaactctcctgcctcagcctcctgaatagctgggattacaggtgtgtgccaccacacctggctaatttttatatttttagtagagatggggcttcactgtgttggccaagctggtctcagactcctgaacttaagtgatctgcctgtcccagcctcccacagtgttgggactacaggcgtgagccaccgtgcccagtgcaattgcatgtgtatttaatgagcttctgcttggggggtagtttagcatacatttggaggcagatgggctgcttcccttattgtatgagagccaggtgactttgtgcaaaacacttgcctgctttgtactttagtcctctcttctataaaacacagatagttctaacactgtatatctctcccaagtttgtagtgaaaaaggattgcacacatacacacacaaagagaccattatgtaagtgttaactactattcttattagcattgtctgggcacaatatctggtgttggaagtcagagaaaatacacagcatgttcttttcttcatggggttctagtctagatgagaagacagtgtccagccactgagagcaatatgcaaatcagtcatcataaactgagtgactgttaggagagagtctattgagggaaacgtgggttatttatagtttgcttgagtttgaatccaggagacaatcttgacttcctctctgcagaccaaaataatctttctttctctcttttcctccctgccttcctttcttttcttttccttttatttttgttttcttttcctagaaaaggtcttactctgtcacccaggatggacaggaggtcagtggcacaattatagctcactgcaacctctacctcctgggctccagcaatcctcccacctcagcgtccggagtagctgggaccacaggcgcgtgccatcacgcctggcaatttttttttgtattttttgtagagacagggtttctatttgttgcccaagctcaactcctgagctcaggtgatccacccacttcagcctcccagagtgctgggattacaggtgtgagccactgtacctggccgactaaagcgatgtctgaaaagggaggacagaatccaccactcaccgccccaaacccattttctttgcagcgtttgctcagactaacagtcagaggaacaagtaaatggcatttgcaaaggggatttcatttattcctggatgccacagttacttgttcacccccaactcattgcaaggcacagggtcttaggaattctttaattgtaaggaacagaaactcaccctgtatgaagatatctcattataagaatcaaaagatatttcacaaaactcagttgcatgaaatatggggaaatacatggatattagaagttatcaggtggattttctgctgccttttgctcttgcaccctctccctggagccttctgctctctgttctctggttgattaagcttttttttttcctgttatcgttcttttaaaaaatttttccataggttattgggggaacaggtggtgtttgatttcataagttcttcagtggtgatttgtgagatttgggtgcacccatcacctgagcagtatacactgcacccagtttgtaggcttttacccctcacctccttcccaccctttctccctgagtccccaaagtccactgtgtcattcttatgcctttgcattctcatagcttagctcccacttatgagtgagaacatatgatgtttggttttccattcctgagttacttcacttagaataatagtctccaatcgcatccaggttgctgcaactgcgattaattcattacttttttatggttgagtagtccatcatgtgtgtgtgtttgtgtatctgtgtgtgtgtatctcacagtttcttcaatgcactcattggtttatggatgggttggttccacatttttgcaattgtgaattgtgctgctataaatatgcatgtgcaggtatcttttttgtataacgactttttttcctctgggtagatacccagtagtgggattgttggatcaaatggtagttctacatttaggtctttaaggaatctccacatgattttccatagtggtgggttaagcattttgactttgtgtgcctctctctgcttgtctctctctgttcgttcatcccctagtgcttggtccagctttcagttttccatggccttcctccctggtcccccaatctgcctctgcagtctctatactccaatccagcattcctgacagggagaagatctcattgaaccagcatggatcagtgtccaccatgagttcccacagttggaaagatttaggggagctcactaggtagatgatggtgcctcttccgtggtggaaaggagtatgaatttgctaagaaaatcgtatgggtggaggaaattggttgacacttccataacacctcccctctgtgttggccagggaaacacccttgacattctgtatctccatcccctagatcgcctctccctaaacaccactcagcctcaccgtcctcagaagctgtatccttactcagttttctttaattggcatcttctaaaataagactctcatattgttgcttcttagggtcacccagagcttgccagaagtgagaaaggatctcttctggacttgatctagatcatgtcatcagatcattgcatcaaagtcaggtttactgaggcataatttacacacggtaaaatgtactcattttagcacacagttcttcaagtttcaataagtgcatacagtgatgtaataaccaccagcgtccgcatgatttggagcatattcgtcattccaaaaacttgcctagggcctagttatagttagtccccagctctagatcctgggaattggcagtctcttttctgtctctacagtgttggtgtctccagaatgtcctacaaatggaatcagaagtacgtagcctttaggcctgactatctctgtgtaatggatttgagattcatccaggtagttgcatctatcaacagttccttcttcccttttattgctgagtagcattctgtggtacagatgcactatagtttattcactagttgaagggcggttgtgttgtttccagtttttgctgattatgaaacagttgctgtaagcatttatgtacaggtaattctgtataacaattcttagttctcctgggtaaattcctaggagtggtgttgctggattgagaagtatgtttatgtttaactttattcattcatttaagatatagactcctgctctgtatcccaggctgtagtacggtggcactatcacagctcactgcagccttgaaatcttgggcacaagcagtcctcccacctcagcctcctgagtagctgggaccacaggcactcaccaccacgcctggttaattttttaacttcttgtagagatgaggtcctgctatattgtccagattgatctcgatctcctggcctcaagcagtcctcccaccttagcctcccacagtgctaggatgacaggcataagccaccactcctggccctttttaacttcataaagatgttttttaagagaggcagaggacagagtggtagtttcggtgtttaatcctggatctgatacttcctagctctgcgacctcacggtttatctgtgccttactggattgcagcagaattaatggcaaaataataactctgcacaagttcagggcagtcactggctgagtgttagagctttaagatggcccctcatcttttggccactgccttcttgtactggatgttccttctttattgcctgagcatgcacactctttcttacatccttgccacacactgtttccttttctggaacattttcccacccacctttctcctcgccaacgcctcatccctccgttgcccaatggaatgccgcctcttcagaaaagccttccctcaccctcagtctcaatccagccctttgctatctatagattccttacttttttttttttttttttttttttttttttagcaacctgttcttatcctttatagcatttaccacaatgggcctcagaaaattaactgtataatttgatttttaattggaatttttattgagataattgcagattcacatgcagctgtaaggaataatacagagagttccaatgtaccctttacacagttttccccaatggtaacatttggcaaaattaaagtacagtgatcacatctaggatattgatgttggtacaacccagtgattttattcaaatttccccaatgttacttgcattaattgtgtgtgtgtgtgtgtgtgtgtgtgtttgcagtggtggtagttttatctggttttgtagaattttaccgcacatgtaggtctgtgcatccaacaccacagtcaggataacaaacatttccatcaccactggatcccttctgtttttctttttacaaccacccccgcccccactcccaattcctaatttctggcaaacactaattttctctctatttataagcttggacatttcaagaaatggacccatatagtacctgacttttaggcattgacattttttgatcaacgtaattccctggagactcattgaaactgctgtgtgtataaataacttattccttttcattgctgtgtagtattccatggtatggatgtaccacagtttgtttaaccattcatctattgatggacatctggactaactcctggatttagctcttataaataaaactgttacaaatcttcaagtgcagggttttgtgtgaacacaagattccatttctctgagataagggctcaagaaagaacatgctgggacatgatttttaagagaaactgattgatttttaaactgagtctctgctgatagacttttagttccatccgggtaagtagactgagttttgtttgtttgtctgcttgtttgtatctttaatcagcatactgggaacactgtacaattcttagaacataatttaccactctataaatatttatagatgatttaaataaggaacgaatgagtgaatgcatgaataccactgctggcatagggattaaatgaaataatttatgtaaatcatgttcagaatgtctagcatggagtaagctctaataggtaaacacttgtagcacaatcgccattgtaagatatgattttggttgaaggtgacatgaggaaatttcatatccttccaccttcagcatcatacaaacatcatgtggctttgcaggatcccaagggtctaggttcttgccactttatttctttaaataaaagcctatcttgtgaaaatgctcaaaagtgtcagagtgggaatttgggtttcatactttgatactttcttatttttttttttttttttttgagatggagtcttgctctgtcacctaggctggagtacagtgatgccatctcagctcactgcagcctcccctgccaggttcaagcaactttccctgcctcagcctcctgaatagctggaatttcaggagcacaccaccaggactggctaatttttttttttttttttttttttttgagacagagtcttactctgtcacccaggatggagtgcagtggcgagatctcgggtcactgcaagctccgcctcctgggtacccaccattctcccgcctcagcctcccgagtagctgggactacaggtccctgccaccatgcctggctaattttgtttttgtatttttagtagagacagggtttagccatgttggccaggctggtctcaaactcctgacctcagatgatccacccgcctcagcctcccagagtgctgggattacaggcatgagtcaccatgcctggccctgggcttcaaactttaaagaagatactgcttaaataggtcagggtgaagctacataaccacttgcctcattgaacatgaacgcaggcaatgcgtgatagaagctgtaggagtgtgaggatgtgtggcacaaaagaggttaactttgttccaagatcattatggtcccagagtgtgacataaatattggtgaagccaatggagttagcacagtacttaatagagagagaagattagtgattctcatttgcctgaggaaagtgcaggtcttgataatgtcttgatctatgtacaaagagctagtaaagacaagcagtcctcataataaaaatagaaatgaggttttcccgacaaagatgccaccagaatgatgagctgtcacacaggacctggagagacaagaaagaaacttctttggtgactataattaggattccatggagagcagcagtgtgcaggaactatgccagggtgctctctttctctttctagaatcaccatcaaacttgctctaaaggaccaggacagcgagtaggtgcaagctgatccttggtggaccaagcctgtattccccacaggccatggtgaggctctgacctggggtataataggcaagaagtgttttcagtctgtgacttgggctacttaaatggaagaagataaaaccttttatttttccttataatgaaagtacttcacgctcattattaaaaacttggattgattgacaattttgaaaaatgataaaagtcgcctctcaacaccacatttgggtgtttcctcaaagctttgaaaatatctatgtagatctatatgtttagatttagaaagagataaatttagaagtggagaacacaaattagtttatgatagattttacatatatggggtattacccaataattatggatttgcatattaccttcccccacccatttcgtgtgcatttttctgcttcttaagctgtttttccctcggtgtattttcaaaatacacatagtttgtgaggatctagcccaaatgaaatgagtgatgtgtgactggctgttgaacgaaaaatccaaaccaatctcgtgtgtatttgctggctgagatctgttttcctcatgttctgtagaagggaaggagtaacatggtctcctttagatgctggatcaaggtctgagatttttctaccttcaccctggtttccatataacagggaaatcctagagtggtttaagatacccacaagcaccctggggaagcggcacctacctcaaccatagtttgtgatcctgtaattcaatttaatttctggagaaagaatccactctcagagaactctcacatcaattgttcaactttcagacattctacttggaaatccatttaaggaatgcatcatacaataaagtagaagattcaaggtgagaaaatcacactcatctgagttagggcctcagggtgtacatttaaataagttatttatcttccctcattctcagcttccttacctgtgaaatgggaggagtcacatcaccttgcttatcagatttctgggaagatgaaataagataatgaatgtaaaacccttggcatagtgtctacacacagtaaatgctaagtaattcttaactgtgctattactggccggagagcagtggctcacacctataaccccagtactttgggaggctgagctgggcagatcacttgaggtcaggagttcgagaccagcctggccaacatggtgaaatgccatctctactaaaaatactaaaattagccaggcatgatggcacatgccaataatcccggctacattggaggctgaggcaggagaatcacttgaacccaggggatggaggttacagtgagctgagagggcaccactgcactccagcctgcgcgataaagcaaggctccatctcaaaaactttgttgttactttttacagtatttcttggacttgtgtgtgcttcttgataggacattggctatgcaggggaacaacattggaatcgtttgtctggtgagaggcaggggttggagaaaagaaagtgacagcctgctgagaatctgagtgatattagaggaagtatgggcaccctggaggttagtgttttcactaaaaagatcataaattattaacatccaacagagttacccagaagaacactcatgccagatcctgcctgctgtatcagagagcctccttagagatgtctgtggctgagttacaaagaagaaaaagcagtcagggtgatgatgggtattacatttgcttccttagtcaaacactagagttgagagagaaagcaagattggaagtagcaatgggctctccttagaaagattaaagagatggctccctttgtttctagcctaagagaacagggctggctgtctttcccacaaaggtcaatgtacattgccttacttttgtgtttacaatcaacagtagccagattatcattaccgataccaacattaccaccaccattatcatcatcaccatcaccatcatcattaccatcatcatcagcaagagcatcactgtcaccaccattatgattatcatcatcgttattacagtcaccttcatcgtcatcatcaccattatcaccatcagcatcaatatgataatgatgatcatcatgattatcagtgccatcattactaccatcactttcatcatagtcatcaccatcatcatcaccatgatcatgatcatcatcagcatcaccacccccaccatcatcattatcacaattatccttgaagctgatatgtgttgtgcacttcctaggtgctaaggggttgcaccaagaaatttagtgtattagtccatgctatcaaatttagtcttgtgagataaaaatattagtgcttgtctcacttataaataaggatccaagactcaggaagttttaaataacttgccaaaagccactcagctagtatgctgtagttcaaagattcagaaccaggaggtctgcctccctagtccttatcatccatttcgttatcaagaaggcaggacaaggttaggataaactctgtggccccagaataagctcttttaattcttattatttttcttcataggagagtaaacctataatctgtgcttcccagggttacatggcacaccactgtttctcagatacctacgtacatttacaccggtagaaaccattttagaaataaatgttacagaaaattccatctataagagagataaaaggagcaggataaaagatgcattttatgacttcaaatgtgaagcatgtatcgtaaaggcaattagtgagaaaatgaggctattttgatgaacaccaatatttgaaattgggagtatggatagataatattgttttcaattaggcttataatccaattcatttcagtcttttaatttgttgcctgctattgagaagatgctggttcacacactgatactgagatgcagaaggtaattttttaaccaggtgaccttaaaatatctcattaatctggaatgtaagctccatgtcctttcgtagttgagcactgtatctccaaggccagcaccatgcttcgcacagacactattttcaaaaggtagctgacgattgaataaatgaattaaccaactagtaaattaaatgaatctcagaaacatgaaaatggaagaggactaatattttcattttcaaatttgctcattcactcaactaatatttaacaagcatccactacagtaagccaagtgctgttctaaggtggtgagcatgcaacattaagaggggaaaaataccgttctcatgggacatgtgcgtgtccgtgtgtacaggatgggggcgtggaagatagacagaaaatagacaaggaactcaccattaacactcgctgtaatgtttagaagcagacagcttatctaagccttctgagtctcagcatgcttgtgggtaatgtagtattatcggtatgtacccagcaatacccctgtgaagaataaacagaaacacacagaggtgctatcatccttgcctccatctcaatattgcaaaacatacaagaatgcacatttcattctgtgattatttatttaactaggcactgggcattctgggatttgtacattcatatcattaaagcagtttcagccaaagagcatatatttggagatgttttaacatgcactgggcataagtgattatagccctaggttcaaggtgaccagtatctggacagagggagatatgtagaagaagtaccagttacgttgcaaggtaagatgtgcagaaccagcttaaagcattcaatactgtgccctaaccagctgaaggggtcattgatgccctttgaacagaagacagacatccttagttttgggtatttaaaattcctctgtggcaccaatgtgaggtatgagttgggaagagctgagactgagagcaaaggaacttacctaagtatagctttttcccccttttctaaaaatctaggctaaataaaataatgtgatgtgctagtatagccacaatggaaaattaagacagccttaatagttgggagatggaagagttaaaaatgatacaatttgggaaccaattgactattcagagcagcaaaggaagatgtgaagggcaaatgttcagctttcaagattaagtaaatggaagggaggtgcttccattaacaaacaggtaagtcaatagaggaagagcagcatgtgcagatgcgtttgtttgggggaatgttaaaatagcagcaaggatgggaccttggcactgagacatgcaggaggctgtctgaagttcatgatgattcctgagatgcagcctgtgaggagaggtcatggctagggatgcgataaggatttgtctgtattctgcaaagagtctgatgcaatggctttcaatcattactgcaaatccttcacaagtgtgtaaagagtatcatagccattactatattactatatataaaatatataatgtactatataatgtattatatataatatataatgtattttatatattatatattatgtatataatatataatatattttatatataatatagaatatatgatgtattatatgtattatatattgtatatattatattatacaattatagtatatattacatattgtatatattatatatagaatatatgatgtataatatataatatatcatgtattatgtataatatataatatataatgtattacgtatgatatataatatagaacgtattatatatcatatatcatatatgatatagaacgtattatatatcatatatatgatatatgatatagaacgtattatatatcatatatatgatatatgatatagaacgtattatatatcatatatcatatatgatatatgatatatgacgtattatatatcatatatcatacatgatatatataatatataatgtattatgttatatatcatatatgatatacatgatatataatatgtaatgtattatattatatatataaggtattatatataatatataatatgtaatgtattatatataatatataatgtattatataatatgtattatgtattatatataaaatatatataatactatatgtatacacacacacacacacacacacaaatatataacagaagtgggttgtgcacggtgatgacgattagggtataggaggtaagagacctaacaaagcacgaagtgatgccaagcgagagttttttgtctatgaggcatgtaagaacgctacaatacatgtgcattaaaaagtccagccagggacatatatagtctttttcttacatgtcactctactgaaatagtcttgaattattttatctgatacgaggtgaaggaaatgctatgttttcatcagtaagcacaataggtcttgtaatggagcgtacaggtttggtttggaaagatggcttgatacaaagctggataagagatgatcccctcaaagacacagaaacaactgttgccgagcttttaaggagcaggaaacagaggatgaaggggtgaggatacgaatttgttctctggctctcaaaaagaaaagagggaagaggaaaaggaagtaaggcagagaaagtctggaaccaagacagtttaatcaaagtcgagggcactagaatagccaaatgtcattttcaaggatgtgatagataccgttgaccctccacgtccttgggttctgcatccatagattcagtcaactgcagatcaaaaatattcagaaagaaattgtgtctgtgctaaacatgtgcagacacttttttccttgtcattattccctaaacaatgcattgaaacaactatttacatggaatttgcattgtattagtaaacctagaagatgatttaaagtatacaggaggatatgtgtaggttataagcaaatactacacatctgtagattttggtgtccttggaaggtcctagaaccaatcacccatggatagtgaacgatgactctaccgatccttgtctgtgtttttaaaatgagaatcacatcttccattctctctgccaccatcttcatgtctgctcatacatgcatcatttagtgggtgtattgcagaatgggctaattaattttatgtgtgggtctttgtaatggaacccagagacagggaatataagaacctggactcgcaggccagatgaggttgtgagaacatgagctgcctgtaaccgtgaattgcaatttggggactaaaacttggaatcctagagattgtctgtttgccgaggtgagatttttgagagccaggaaggttttctacccaatacccgatacatccccagtgtcaccttgtaagttttgcagataaacctagtttcgtatgattccttacatcgttcctagctcacctccaacaatcatcagactttgaaggtatgcaatgatgccagggactaagaattcctggggtgtctttgacctgtgttccaggatgagaccctgggaaggtccaggtcaaggtggattaattcagagctggagatgttagaggtgaagtcacttctagtcagaaatgcttaatgacaactcatcttgtactttaaagataaaatttctgagcatttctggggtcaaagaaccttgcagccaagctcatgaaagaggaaaaagagaatcttctgcaggctttgtttgccttcaggtttgcttgagtttaatccagaagtcgaaacacagagagtgggtggggtggagggttcccaaagtagaccttcccacccacttgttcattaggagaaatcaccacttagctgtttttgtctctgccgcctacccttccttgtcccacgcacttacattcagtcctgtgcactggaaacagactcccaccctctcaactgccaaacgctgcaccttgtctttgcttcacctcctggagtccattgtttcaggaaggctgctataggaactgaagttacttgcttgctctgggtaccttttaatttggggttctacctggtgtgtctcgggtctcttttgacatatgtcagttggctgctctgatagaacattgtctccataaattgtcacttttgccagaaatgatgataggaaagtgttggcaagaaaaaaaaaaaaaaagactgaagcagaatattttcttttgaaaagcttagggcaagctgtggatagggtgggacttactcctgctctaattgagtaaggacaagaaagctaggaaaatttcatatgataaaattaggtggctggggtcagcgatatattcctggaaaaagaaagcttgaagataaaatggcatagagtagttcttcacaaaagtgcttacgaggtttagatattgtaaaaaatgatgaatatgatgatgatgatgatgatgatgatgacagtggtgattttgtaagcagcatctctactgctgtttgtattgcatggttaaaaaggatactttctcattttgttcaacagaccagaaaaccctgttttccatctcttattagaaggataagatagatacttcttgtgccctcagtttcttcttatgtaaattggaactataaaaataatctaccttgcaggattttgtgaagatcagaaaaaaattaattaccatctggccagaagtaattttctaacatgtattacgcttgtcagtcttcacaaaatagtgaaggacttgacctgatgttgtgtgagatacagttggtgaagattttagttgacaagggttaatgtgtaagctggcattcatttgattcattagcaaggttaaataaattgtgtactcagaagaccagggcagaaaggtgatgtgtatgatgtctatacatttttgtatagtgccatgtcatttaaaaaaactttacaaaaagaaaattgtatctgaagttagtccttccataaatgtattgactttgttggtctcgtttgtgtaatttttttgcaaagaaggaggaatgatggtttcatcaactggtcaggggctgaaaatagaaatacctcataataatagttgctatatattgagtggttgctagataatgggcaccatttttatgacttatatatattacatgattttatctttcaacaacttaggaaggaaaagtatcattattctccttagaatgaaactgaggttttaagaacttgtatgtcagtagacatataatagcagctgcaaaggtatgatccagagatagatcttcagaccaagcagcaagactccaaaaggtgtactgctcactacaggtgtactcaggggagtacaccttttgcagtctcgctgtttgtgtttgaggcatacccacatatgaaccagaaagagttcccaaataccccatcgcaactccatatttcaggtggccttgaacgagcagggctgagtcattgaggaacaagaataaactctggtgatccaacaaattcaattcatttgacctttattaagcctctcctaagtgaaaggcatgctgctctgtggttcaggaaactcagaaatgagaagggtgtttggtttggtttgctgcagtgaacctgtgggggtaaagagaatagttattcaagcctaaagagtgtaactattaattgttttttagtctcctcgtgatagctaacaagtattgttgatacttgttgtgccagtgcctatgctgagaagcactttacattcattatctcggtggttcccaaatgccgatccacagactcattggattctgtaatgacattttcgacagactgcagctaaatgagaaaattaagggcaatttagtgaaaattttaatagacttaaatttaatcaatttgaaggactgtcctttattttcagattatgtcctcctttttttttttttttttgcattttcgtgtaaaatgctgtttcttttattaaatgcttatgacagtagacagtgtatgtgagtttatgtgtgtatgtatgaatgtactaccttggcaagaaatttaaaagctgttaattttcatgcagtctctttaccatttttaaacttttcttggaactgtccatgtcattgagggctaggggataagaagtctgagaatcattatagttctgtaagggtgctaccattggccccattttacagatgaaaaaaactaaggctcggaatggttagctcacatgctcatgttcacgatagcttgcaagtagcagagcttgaatttaaaccagtttgtgtgtttctgtagatgcagaacacctgcatgatgggcatatggctgcttttgctgcaatgaataggctccctagcctgtccctggccatggatgtgggccatgcaaccgttttcagagtcccaggactctgggcctttctttcgggtgcagactgaaatccacaatagctttagacattcatggtgtttcctaggagctagtttgcagcagttctattcctctacttggaggaatacaggagttaagagcctagctttgtgtcccttccctctgcccctgagtcctgtgtttctgtttaccctcaaaaatgtgagcagtataggtatgtgtaaaggtaaatgcagacatcctgcttagtggcttacagcagaacctcatgtcaggggaagagctgggttgaaagatcccgttttccaagcttgcactccatgggagccatagtcagtagccagtgagacgacaggaggagagacaaggctcaagggtcaagggagaagacactgtctgtacctcctgagctttctcttcattgtgcctgcagggaggagggaaggcagtttgggccatggcttgtaggaacaaaaaaggacaaacttattttccacatcttcctgctttatatgtgaggcttgatgtaaagacaaactaccccaccctgtgagatgggtaattgagaatgagacataactgggtttggaaatcagttgcatcccttctcttctccagaaacatatgcaggtttccaacctggcagtctgtttctcagcagccttggcacctgaggaaggggtaagatgaggatctgggtatttttattttgatttctgacattgtccctaagaagttatgctgtaaacggataagagattctgggttactgaaatcctgtatggatgctaaggtgctatgtagcttagtccattcccttttttgttgtggatgttaattatctagaatattgcaactcagtagtggctttaagcaggttttcatgtactagccagggaaagttaccaccattaaaaaaaattattctttaggaacgtgtagcctggggtctttataataacaacagttgtagtagtagttgtagtagcaatgatgataatataactgtttcattttattgtaaaagtaatacacagacacattcttattgtgaaaatctaagcgacataaatctgtacagagtaaaaattgaaatcccccccaatagcccctcctctattaccctagatctaaaagcatttattggattgatttatttgtttccgggcccttttgtatgcacttcacatgactgcatgtatgcctattttacgcacatgcatatgcacatacttctgtggatgtctatatgcatccacacacatgtttttaaagaatcgtagagttttgctgtttgttttggtttgatttttcacatgtgaaattttgttatctatatcctgaaacttcttagagaattttcttagagatttttccaaggaaagacactcagatgccccgcattctttttaactggtgcattgcatgcatgtcctgtaccttgttttatttatcccctgtttcccctattgctgtttattatagttgacccttcagcaacatgggggttagaagcatcaacccaccacaatgtagaaaatttgtgtataggtttttttttgtttttttttttttttttttttgagatatactcactcttttgcccaggctctggagtgcagtagcatgatctcagcctaccgcagcctccgcctcctgggttcaagtgattctcatgcgtctgcctcccaagtagctgggactacagatgcgtgcgactatgcctgagggctaatttttgtatatttggttgagagagggtttcaccatcttggccagtctcatcttgaactcctgtccttaagtgatccactcgccttggcctcccaaagtgccgggattacaggcatgagccaacatgcccagcccaaaatttgtgtataagttttgattcccccaaaactatgattagcccactatcgactcaaagccaacagtggattaaaacgtattttgtatgttacatgcattatatatgtattcctacaataaactaagctagggtaaagaaaatattaagaaaatcataacgaagagaaaacatatttactattgatcaagtagaagtgaatcatcataaatgttttcatctttgtcattttacatgaggtaggctgaggaggaggaggaggacgaggaagacaaggggttggtcttgctatctctgggtctctcaggtggcagagaatttctgcatatgtggtcctgtatagttcaaatctgtgttgttcacgagtcaactgtatttgcttttacaagcaatggtggagtgaatatcctggtttatgtatcatgtatctacctcaaatatttcagcaggacagatatctagaattagaatagttactttgaaagatgtgcgtattttagattttgatagtgagcaccaaaatattaatatcatctccaggactgtaccagttttgactcccaccatctgtgtttcaggttacccatttctccacagtgatgtcaaatctatatattattgataggcattttattcgttatttgattttatttgttaactgatgtcagtcttttaggcaaaagatggccgtaaactgttctaaaccaccaatgtaactttgaaaagctcatttgtagtgggagcgagttgtgaactgggtattgcctgcgcttgtatttctgctcttggaagcgtggtttatttttagtcctggactcactgacaacccacacccaaactagaaagctagaggagtttgagggtcctttacacagaatcaggctctaatctcgatcctgtcattacatgcaaagcaattgctgctgaatggttggaattggttctgcctgggacgaagccctttactctgaaaaaggagcgctgtgctcatttgagcactgccaaaatcctggaccctctgactcagtgtggagtgatcgtgcttttgcctagagaaactgtgtctgagaaatggagcttctgcaaaatacagctcagagggaccatcaggggttgagacattctagaggccaacaggccagcttaatgtatacattagaagtgccaaacttctcacccctatccctagtagattgacccaagagaactacagaattcatgtagacatgctcctcagtttacaatggggttatgtcctaataaacccattgtaagttgaaaatatcataagtagaaattatgttttcgacataggatattttcaccttaccatggatttatccagatgtgaccccatcgcaagtcagggaccatctgtattaaacaaatgtgaggcttatgcaataagattggaaggagcgggatgcaagaggggctttcttgaagctgaaactgcattttttcagagcaagtgtagtttttaggtagatttcactgccgtctcccttaccctggtttccctaattccctgatcttgatcttgcctgctatgcttcccacagcactcaccaccatctattgtactgtacttatttcttctctgtattacttactttctgctgcccctcccccacccactagaatgtaaactgtctaatgtcagggacctttgtttgtccggccccactgatgccgacctgggggctagaacagtgcctggaatgagatcagcactaactaaatatgattcaggtgtttgaacaagccagtgactcaaagtgcttttgatacagataaataataaagttttctaaagatactttcatgctcactttaatgaagatggagactatattgtcgtccacattaaatttggaagtgaaagtaaaatatttctaagtcacatcttgacgttgccactgagctaaccccagtatagatgattacattgaagttcaagtccttctttctgtctaactggagtcttgcttgctctgaggtatggcaactcttatagaaagtattttttttagtggaatgtctgctatttcaacagccttgggaagttataataaatagttatgaaaatgagaaaagaaaaaaatggtttccattcttcttttaaattgctggcaaagttggaagaaaaaaagttacaatattattttatgagtcaaattaaaacttgggtagttgccttctgcctaaggaagtttcatttgaagatgacattattgattgccaattttcctgcactttttcagcttcctgtggggtatgtataaccattccattaagggtccttgtagctgaaatgcaggcagggtggcccttgaatgcatatgaacccatgtgatgttgaatgtctagaatttttttttgtggagagataagagtattttctttccccacttctcccatttattgatgttggagaatcatgccagagctagtggccttgatatggctctttctcagtctcttttgagatggaattcaaatttgctatccccagatgcggtttaaaaggctggcaaagtgttgtcatcaagtgagcgatgattgtggatatgatgctaccatttgatttggggtcattggatgccctattcctgattaaggagcactgatgttatcaatggaaaagtgttcctctgggctccttaatatagttgcagtgtttatgggaaggggacttgtccctgtgtgtgattgtgtttgcatgcactggtggagagatgttcaggtttagttatccagagagcagagcccgactccaaataattttgatgtggatttaggtctggttctcatgttgtactttgcagatcttcagtgtgtctgactgtgaaaacttaagtttaagggaatgtcagagccgttattgcaagatggatctgtggggatctaatcactactgaggggttccaactttggggagaaaacggactggaaaatctgtattgccttagtgcagccaagagcatttattgggtctttacataatgtatttgtttttcattaaaccgttcagataaagtcttattaaagtgccatgtattatgtatcatgtttcttatgaaaatgagctgaaggaaaaaattctctcctcttcttgggttatttacaggcttttctaatgccagcaagagaaaaaaaaataaaggaaagcagtgcgaacccgtccgtacagcagattgcttgacgcaacagtaaagaatgggaaagggagagtgaggattggaaaggtagaatggttggccttttattccattcgtgttctgtggagtgactttctctttagttttgtgaatgcaaaaataaataaataaaggcaggtaggaagtaagagaagaaaagagggaattcttatattatttgttaatcaaagcttgtcccatgaatgtgacctctgatgcaacgtacagcaaacgtttttcaaactaaccactgccagcaccccccaataaaagcagtacagaatagcagcctctactttcccactcccctggatgaacttctgcctagggctaaagggttaaacatgctactgtgtccctgataaattgatgggatgtgtgagccccagagaggttggaggcactggttttgcaagatgaaaagtggaaagaaacagcgggttggggcctagtgttaggcagagtgaagacttcatagttatttcaaacagaacgacaacaaaaaatagagccgtgggataattagttttcttttcttcagaaagcattttgattagcctgcaaagtgagttgtgccttgcgagctgatggctgggttcagagccttcatttggctgaggatgtcggggtgagccctgaggaggaggggatatttgggatgtccctggtggccagttccagggttctgccccaaatattcttttgtgagagagcccccatcccctctcaggtacggttccgtcctgcaggtcagtgagaagctgtcagcaaggtttctttcaggaagcccaacaatcaaaaaagctgctgtttagacagctgatctcttggtctgaaaacaaaaaaaaaaaaaaagaaaatccaatcactgggtcaaaatctatattaaaaaaatatggctactcttcctgatcacgattttattgctgccaagaatgcaagaatgtgcttttttttttttttcctgtcaggaccaaggacgagttagagtcttaatattttctttcgatttgcagatcacatcctattttattgcataaagactaatgaaatctactaatgaataattattacttcataaaataaaggggaggggagacccgtttgcaagagcagaatgttaatttggccaaggagggctggacaggcaagaataaaaaaaataaataaataaaccattgtaatttgctccctgcagccgacggagtaatctcttatcagacacggacttccctaccctgtgcatttataatttgagaggagcgggtgttctgggctgggagaagcccccttccagtcgccccgagctggcacgttagtccaacaggcttgatttccacgccagcctgggcggttgctctcattgaacagctcaggggctggttcgctggctcggggctgcctgcccaaccaaggcgaggcacagagcgaaagctgcgccccaaacgcccgggggtgcatcggcgcttcggtgctctgctggggggcgcagaaacctcctcccctccctcagcccaagctccctcctgcccccagcccctaacgtctcagcactccacctcctgaggaggggaaatcccttttctgtgtttatttggcaaggaatccggcaaacgcaccgccaccaacatctaccactgtgggtcccagctgggccatcgcgctaattgtccagctcgcctgatgccgggcgcgcggggcgctcgctcgcctgctcaccggcagagggttttagcagaccgaatttaaattttggtgagtgtttttttgaaacaaacaaaaaaaataaataatttttaaaaaaagcgaaggggagggaaggaaaaaaaggaaaaaaaatctttcccctggacccatttgacaaatgaggagacagacagcatcagaaccaacggagtgagcttcagtgtgagtcaaaacctctcttcctctctttcaatctctctctctctttaccctccctctcgctctctctctctctctctctctgtctctcccctccctctctcttcctctctccctctctacctccgtcccaccccttcctcctctccctccctccctccctctcgctatccttgcccccctcccattcagcctcttcgggagggcagcgcatcccctgccccttccagagaagttccctctgccggttctcgtgtcaccttcacaggggtatggggtggggggccccttccactttccgggggatcaaaaagcaggcccaacaacccagaaaagccagacgaccgcgcgaagggaaccaactagtttccaggtccccgcaagtgttttagttggaggcagaggaacgccgggatctagcacatccccaggcggggagagccagggaggagggaccggcggggtgcggtggggggagggaggaggaaagagggggagagagacagagagagagacagagagagagagagagagagagagagagagagacagcgcgagccaccggtcattgacttagataaccagcaaaattaaaaaagaaaaaaaaaaattgtagcgcccaggcagagagcaacgtgattgcattcaagcgtccccactcgggctcggcgggcgccagagagacatgatgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttctgcacctgtccgaatactttaaaaccgcctgatgcccagcctgggcaccggaagtttgaaatggaaaactgccttttccttgctaccatcttccttgtgtcagtgcctttcgtggtgatctgagtctaagacccctttgatgctaagagtttgaatctttgtggaggcattccggtgcctgtagtgttaattcagctgatttaatagagagtggaaaggagaagtgtgtggtgtgtggtgtggtgtgtgtgtgtgtgtgtgtgtgtgtgtgtgtgtgtgtgtgtgttttcctaagtttgtgtggtgctatattcggtccgcatgggatcgcagcatttgaatttctggagtgtgtcagccccagtctgccttcaaactcactggcaatgctgtgaagaaggtgagctgtttaggatgttgtctttgttggcatgtgttagggtgtttgtgtgtgtgtgcgtgtgtgggtttttttttccctttcacttctccttagtggtcttgctgagggagtctgtgtttgctttattttccattcattgtgcacatttcagtcttttgacaccttactctctgtctttctcagggtgtttccttgggaccctctctgctctgtcattctttctttattggaagggttgcttcctgagttggttcctgggcttgggaaatagctcagcactgcccttgtagggtgacaggccagctctctgtcattgggcaggggcagtggatgtgaactgaagggctagaaggggttttgtcatgcagatgaaaatcctttctccctcccaggatctccatcctattctatgaaggtttacagtgattatactcattttatctgtttttccacggactcacttcaagagtaccatttgttaacatgagtgtgtgaacagaacttcctatgcaagagttgagagtggccctcttccccaagaccctcaatttcaacctgtgttaaaggaatgtatatttttataaaatgtcaggattctgttttgaacatttgggtgattttctatcaagttggttgactccagaaaatatttcttaggtgtattttctgttgcatgtctttttgagaacagtcttaaaaaaatcttgggaaccaatttgttcttttaaatattattttattacgttcattattgagtaaatcgtgccagaagacatttcccaagagagtattgataacatattatatgcttcatcttccacaatttctgtgcctttgctgtgggtgtgtgtgtaaatgtgtatgtgcatgtgcgttttataccagttatttccaccggaagaaaattctaatgagcatttctatagatgctaagcctcagttggatttatcaaattattactgagttgatcttttgccttttacatttacttctttcatgttatttattaatcaatttgaatatcatttacctagcaagtagaatgctataggtactcaatgttctccgttcctttgtgtggtggtgtttgtgtttttttcaaaaatacatccatgtttctgccttctagatttttaaattggcttactcatttgggcacaacttaggagagaagatagtgactttgagtgagaggttattcttgccatgagaagaacaaacatataagataaacacaaaggttctcagcatcttccaggcagtctctcccacgaggaaaaacacccctgctctggaaaggggaggcttgaagaaaacattggcagccacaacaaatatttagaagtgactaaatcagcatcatggttccatatgaagatagatggagggtggattttgaaatgtgctttggaatgcatctccccctcccctgaaaggacttgcactgctatctgtgaaagtgtttataatgtgatactatgacataatgtgggaatggtgtgcgtgtgtgtgtgtgtgtgtgtgtgtattttctctgagcttcactgaatacctgaagtataataaaggcagtcatttatttttgcctgtttcattcagaattaggttttctagcccttcctggaagctcaccgctagggtgtaagtgatatacctggagtcatctgtcctggccattactgtcgtgatagttcgtttaaaagtctcaagtcacttattttatttagcattccagacaatcggctgattaagagtgtgaaatagtttaatctccacatacataaatcatatcgataagtaatatcttgtacccagacaccactactatattttttatctgcctttaatctgtagctattattggatctctagctaattttggtgaacagaagggtaatctttgatctcaaagtaaattgatcaagtggacgaatcaggcaacatttatgataagtaacaccttcactgaaaacaattttattttataattgtttagaaataaacataattcagaagtctttgtcattgagatcaccaattacataagaaagtaatcaacccacattgatcttattttggagcatttatcattttgttttataaatccacaaactctgaccaccggccatcgagtcttccctgaagtatatttttctggaatgcagtttcatatggttatttcttatccaataactaaggaaaatgacttcattaaatgctttctttgtctcagcatgaacatccaacctttcctcctaaattctcacagatttatccataagacaactcataaaaacaaaaatcaattggggtgcctcagcatcggagtctactctgaatggccaagtgtaagtggcaacatatcacttttgccacgaataatttatttacttaggccaatgaagaagcaactttgatgtttacattatttgacttatcctgtttcacttatttgtatgtcccaataacttttatctagataagtgtttacttacagctacgatttcttttcttttctccttctcctcttttttcctccacatccaagatgttactacagtttagagctgcaaggtgggataatgctaaatagtttttttggcgtctagatatcagacccagtgatgtactcacataggaacacacaaatttgtatacatacacacagacacatatacacacacacctagtatagagcatatattttgtggttgtcaaccactttcagatggaacggacaagtagtccttggagcaactggcttcaatcttgctgtccagggaaagtccctgcctcaatctcctttcctgagtggcttcatgctgtgtcttctttgatggtgaatcttcttgaagctgaacttagaactcacatatccccaatacttaatcttccacgttccaaagtaagtactcatggaaccattcttgctttgaggaataattctgaatacaattccacattagggggtttgcagcaagctaggtcaaaagagaacctattttgttttcctgatagagaagaaatagaaaacagccacacacacatgcatggacacacaggacacagaaatctagagatggtttatttctattgtaagtaatagagggcaaaccttatagcacccatctcatggtaaggtatggtgaggcaacagacaggatggatgatgagattcgttttctgatgcaaactgcgtgtcagattccacccagagctgtttttttttttttccactgagtttaatgtcctgaaagaggatcagtagcatattaacttaattttctctgttcttacaccaccagcgtctctcagtactattctaagaaagcttcttatctgtcaagccctatccactgagaacctttttatcagcctaaatttaaaaatacgtcaaatgcttaaaatccacattagagggggcagaaaagagcctctaaagtgggccatgccactgtcaatattcgaagattggtaatttttcccacttaatgatgatccatgtggtttgttttaagtagtgaagtggtttgtacaaagggtaattcccagtaaatgaagccattgctcactgtggacatcttcagatcgaaagcaattgaactgaaacctgcatatcaaccctttctgtctttaattagaaagcgattctcagttcagggaatcacctggggaagatgggctctcgcgcgaaggctgcaggcgttggggagggtggccccatgcaccagccacggttataaattttggaaacattaggtaggtcataacaattatgactgtgtagaaaagttcaattctcattgcagttacttaccttgtgttactccatctgatgatttatagggggccaaatggaatttatcacattctttctttttggcttaatcccgtgttgatttattagatagtgctatggattgggggtggtcgatagtgtcagtaacgcagaaaagaattaggatagattagcttcatgtctgaattgtttaaaggaatttaagtggctggaatgagcacatttccaggcccaggtggctgcctgatagaagaaaggtccctcagtctctttctagagggatgtcttacgtcgtaaattggttaaccaatctttcttgtttctctgatcttttccgattaagagaaggcatgaaatgttaggctgttatcagccaggtaaggcccacatttcaggtgagctgggggtcatctgtgcttcccccctttggggaacctatggagggccgcgtgttgtggacatggactgcagggccacctgggctgcctctgctttaaaattacttaatccaacaatcacttctgaaaattgtaagcatctgttcatccacagaccaaagccttgtgccattcgcctgctctgcctgccattttgaggcagtttctgtgttataacatgcaactggccgctcctgcctttgcccggctggagaaagtctgtgttattagtgctcacccgccatctgttttccttacagctgacccttgagtaattctccagtagctgatggactgagggtagacagtcttttttagggttttctgattcatttaaccaggttctctgccccaagaggaaacataatgcttgtttattcatattggccgggtgaaaacagtgtagtttgtcaggcaaataatagtcctgtggaagggaacgaaattgcagcattgtaaacaaaatcaggttgctgactctgtgcctaagggggttgggtgatgagcagcacatgtcatcccgtgaaggaagcagagctgacaggtgtgggtgtaattgtcccatctgcagacccctttttaatggacggggagaagtgtcccaatgttctgtttaattcagttaagaaaagcaaagaaagttccattcatcaataaagtttcctattgccgggtgctgcccaagagaactctgccgggctgagcgttggcccgtggctgttggcatgatgcagcttgcctcacccagccctattgagggcggctgtgtcagatagggtcagctctcaggcacaatggcccagaagagccctggccctggccctttaaccatgctgaatacaggtgagctagccaaatgagcaatggacccgcaggccgcctctgctgggagacagagctggccagggttctctctgaaggatcctgaaatgcagttcctgagcctggcatacgatgaggaaagagcttgtgtggttggaatgtcctggctcctgagagggtttggggaaagaggcttttcatggttgtttctgatcttcctgtcatgctatagccctgatggattgatcccggctaaaaaagtgacagaatttggaaccagggttggtggggaggaggtagagagaaggagaagatgttgatcaaaactgtaaaaactgacgttaactgtggagcacccagagtcctgttggtatgttttatcaaaacttcatcaaggggcatacttattaacatggaaataattgtcatggtccagtatttctcaaacttcagacattcaggcaccacttcctaagtcctgccaatctacccattaccagagttgatatctacttaatattttttaaaattaacttacatattaaacatagacttgcccaaaccaaataaaacacagtcactgaatcacacctgtgatcacactttcccagcatacgtggaactaaatgtgtattcattcacctgtccatccacccattccatgttgatggaactcctgataggtttatggaactccagctgcccttctagactctcccagggagcaaagcaaaggcccctgtcctcacagatagtctgttacgttgttcatctctttgccatcttgtgaaccatgcatgcagtacaacgctttggaaaacttccgcttggcctgctggattgcctgggaatcctctgccgtgtccggtctggaattactccttccgctaccttgacccaatttgcaaggggcaaggctagagttaagttctttgtgatgcttttttttccatctgccagatcagcagccactagtgcacaataaaggaaaatagccatacattcaacgtctacatcccaaggagggctttgagatgatggagctgggactgggaaactgctgtggtccttagcactcagccaagctctagctgaagagcagtcctaccctgttttgatccttttctttatgtgtcttgaaacagaatcaaaattaggaaggggaactggagtggaaagcattcagaaggttagtgtgtgttcccagggatgcaatgactattttttttctccccttttgtggccatagaacaaagtagaagcaactgtaggatttaagtgactccaatttcccaggcctgatgagtaaatgcataaaaggtttagtcttgatgagccttttcttttttttttttttttttggcattcgatgtttgctcaggattcgcctcaatgactagattccccttatcaaaaacagtaacaaacatccccggtttttcccttccatagatcagcttcctcttgctctgcctgaagccaggcacggggcaagccctgctcttatggaaaggttgagagcaatattggtacctaaacccagaaggaacagcgaggtttacacactgcagtagccagctgtccatctcaagtgtctcacaaaattcagatgaaaaacccagatctatttagagccagttggtatcatggtatcagccttcccaaaagtacaggtttttttgaaaaacgatagtgtttctgaagttatatgtaggacagaagtcatgagctgaaggcttaatcccaactctgttattcaattagctgatccagctgaattgagcaagatagtttttttttgtttatttggggacttaattgctccttcagaaaaacagggattagaacaaccatttcatactgttctttgtgatattaagtaagatgcaaatgggaacacttagctcagtgcctggggtgcagtgagcagcctatagatgtttgataaagaaatgaaggaagggccgggcgcagtggcccacgcctgtaatcccagcactttaggaggcagaggcaggtggatcacttgaggtcaggagtttgagaccagcctggcctacatggtgaaaccctgtctctactaaaaatacaaaaattatctgagcgtggtggagcacacttgtaatcccagctacttaggaggctgaggcaggagaatcacttgaacccaggagacagaggtagcagtgagccgagatcgcggcgttgcactccagcctgggcaacaagagtgaaactctttctcaacagcagcaacaacaacaatgaaacaaaggaaggcaatatgttaaagaaacgtaggatttgtttattgaagctggacataaacttctcgtttccatttctctcaaattaacatgattaatacacccatggcctgccaaggacacagacacaagggacttgggtgtcactccgggtcttcttggttccactaccctgtttgggagctcttctctttcttcctccagtgagctgtcattcctgcttgtgtcactggattgtaatatggctacacagctcaattaatgctcagtgtcaggaggagggaaaataaaaattgtcttgctcttgtcagtagcgaagttatttactttcaaaagctgacagaatcacactgcagggccttcatttatttccattcagaacgtcattattctgtgatgccagagacttgggcacacgttgaagtttattcccataagctttaatatggcggggccctgctaaagtgtagatcgtcacccaggagagtctgggagagtctggcggagctctctgggggccccagggtgcctgggtgcttggcactgatgtctgggagggtaccctagtttcaggatggaccggggaagctgacacgtgcattttcatgccctggatctgttgtaggagaggcagcgtgttccccactgctgctcttccttctgaagcaaaagaaaggggtgtgggactcgtacttccacatcactcttcatccgggccactcctggaatttctggaaacacaaaagcgcctcctgaaagtggctttgctttggatctatctattgtctctgcttaaactcgttgacaggttccctcaaccaaataatctgtataaaactatgcaattttttgtttgtttgtttgctctctttctttcttccttttccccctaagggtttgcaatgagcagttaacacaggaaggggttgagtggagaaattctcttttcttcatggtgcagtggcagaaccttccactgggggtctccatttagagtacgtgactcaggattcctgaagactttcttttttcctttctttcttcttttttatctttttttttcttttcttgtctttttttttttaaggctctttggttccgttcaaaaaatgaggctctttcggacagcagtaggagaggcagcttgtaagaccatttaggtaacgagataagccagccttcttccacaatgatgatcataataataaaataattaaaataatgaaataatcaataacttttatggagtgctttgtgacaagcacacgaataagcacttttacatggattatcacatttaatcccccacaaaaaaagcctccagggagttgaaattaatggcttcatttttagatgcagaatccaaggcttaggtgggagagctgatatttaaaaccagacacttttgccccagaaccgacacttagaaccacgattctgcaccatccctatgtcctcctcctcactgtgccggccagtggctggttctgtatgatttacggagagacctctgccaggttcctgcgttggaagaatagctccaattgatggagtgggcctcttttcctttaaaggcaggacttgccaaaagaggaaagagttcaggcgacctgtcaactttgatgctcttcccgattttgttttttttaagtcattacgattttgtttaatgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcagggctgattggtttgtttcacagtggcatcacggtcctatttgtttcccatttggtgtttatgctttatggtgttgtctgtgaaaatgggctgacactcttttattagcataaagagattcagatcacattagaatcctccgtccttctatatcatcaaaaacaacaggcaggggagagggcgagttgactgtaagccgaatcaccatttgttcacgataagtcaacaggagcttgatgtgatctttaaacaaaggggtttttgagccttttaaaaatgattctttttcaatttttcactgaaaaagaatgcagcttcgttttgaatgttatcgaggacatttattttccggattgggaattctggatgtaggaaagtttcttctcttgagtaagccacagaaagctctaattttaacctccgcttttatttttttcctaattggaagaaaacaaatcataacctcatatattttatttggagccctcaatcaatctttcaagataccagcagagaaaagctctttttttttttttaatgaattgcacttgtacttgtgttttcttaattatgtcatgcatttcattttgtgtgtggtgatatttctttccctatagaactgagaactgaaaaccaacagaagacagagtaggagtttgagggggtaaaacagaatatttagaaaattagaatgatactttaaatattccagtcaacagtaatatttttgtctatgataaaatcttgattttaggaaatgctcttgagttaaaaaagaaagatacgtaaggcttttaggaaataaacatgtcattttagtagaattctgaagtgaatacatgaaggaataaatgcaaagacaaatgattaaagccctactctaccctacccccccccccatactgggggcttgaatttcttttacaaatgtgaaagttttagctatctggttcttattaacatttatgcttataaatttttttaactgtccagtatgcttgtcagtaatgatgaaattgaagcaaatattcattgtggaagatagtcttttatagccttcctgaaaagtggagaacagaatatatatatatatatatatggaacattacacacacttttcatcatgggacatatgatacagcattttggactcggaaagcaggtgtccagcaaatgcactttacatttatattgtactgatttttgtatttttgtttgttctctattatttgaattcgtgagtgtctcattgtttttaattatgtctacatggcacaagacagcagtcaacatctgctctattgtttacttggtttacatatatctttgatgggttactaaacaatctatttttcaaaccccaaacagaagaaacaagctgaacccatattacagcattttgtaaagacccattatgcaattagcacttgggatttgtgcaaatctggtgattcacccaaacaaacatccctttattctgatagttcttcctggctttgtgagaaatatcagtttccaaaaaaataaaatcacatttcctctttaatcatgcagcgtgccaagaagattatgtgtttatatgagggatggatcctccactttgtgtatcagagaaagatcaacttttcaaaataatgatgtctttaattcaaggcagcagttactatattacataagacaactatctgcttacacatagcagacttttgagagttacatggtactattggagaagagaaatgctatgtttttacctgtttgtataatcttcctaacattgcatgatctgtttacagaaggcatagctggtcatctcttgcaaggcatgtgaggcccagaatgattaagtcacctcaaatctgattatttctctgaagtcaatggttaataattaatttactcactcattcatgcagcacatccttatttagcctctgtctcagagattgggttggtcattgaagggatacagacaaggaaagcaggtctgcttttcttcatggaggttacaagtctgtgggagagagacagcccatgagcaagtgatcatcacataactgtgccttgccaggtgtgataaatgctctgaaggaaaagagtgggagttggattcaggggtgagggaagcttttttgaagaagtgacatcaaagctgagatggagtgggaggtaggcaaggaggtggggtcagggtggaagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggccaggagtaaaacgttttgaaaatcaagcctgagattcatccccgaagctgatgttcagccagaagagaagaaatgcaactccctgaagtcagacttcggcaggctttggtgaagtcaggtggcactgacctgggtggtatgcagcttcatggaagtgagtgacaggccagtctcagcatatcttaggccaaagctcccagagctcagaatttttcatctgaactctaccatcaccaccactatcaccactgtcaccaatccagtgctattatcaccaccactatcaccatcgccattaggaccatcaccatcacgaagcaactggtctcatgtatgagttggtagcagtcaccaaagacaaaggcactcaccagcttggtaaggtgctctgtagcatcccacttctaatatggtgggtgagaagtggggagtcatttttatgaaatgtccactgagcagtacctccacccgctgcctccagccacaggagtacaggagtgaagtgcattcacgggaatgtgaaacagaactgactttgagtctgaaacaaattacaaatcttatgggcctccaactagctctatgggcatgtttctcgacttctctgcagtttcatttctacatttacgaagtagaggtaacagcaagaccacaaagacatagcattgttaggagtatggcacgagctagtttgtatactaccccagtacagtacccagcaaacagaaggagctcaatacatacttctacttttgatgctggaggtgatggtggtgatggtggtggtgatagtggtggtgactgtggtggtgacggtagcgatgatggtgatgatgtgaaaatggtggtggtggtgattgtgaatggtgacggtggtagtagtggtgatgaaggtgatggtggtagtgctggtggtagtgacggtgctgatggtgatgtagtggtgataatggtggtaatggtagtgacggtggtaatgatggtgatggtgatagtgatggtgttgatagtggtgttggtggtgatggccatggtaatggagttgggatagtggtgatggcagtgatggtggatggtagtgttggtgatagtaatggtggtagtgctggtggtgctggtggctctggtggtggtagtgacagtgctgatggtggtagttgcagtggtggtggtggtggtgatgatgtttggtgatgagagtgattctggttagatgcagcgtggtagaatagtttcacacataagtacctggcttcagatttggttcaagtctaccacttaccacctttgcaccgttgggcaaattatttaacctttctttgttttaattgtctcatctgtgagatggggatggtgatattcattgtcattatgaagactaaattatttaatgtttgttaaaatcagaatagcgttcctataaacaaactcttagacatagagaacgtttgttaaataaagtgtcagtgcagaatacagcttttaacaaaaaggtacctagtggcttctggacttctgctatattcttgattttgctttttatagcaggctgaaaaggctgtctttgccttctctcaaccgccagacccaccccccatctctccatgtgttctgcgtagaacaggtgtgtggtgagccgaagttctggcagagcgcaacatgaaaaagactcccagtaattataaaaataacaacgaaggctgcttagcgaggtaggcagatgagcacaccactagccagaatgataaatagcgcctgcaaatgttaggtcccagtgggagtatgggaacatatgggatgaaccacactaaaagttgggcatcattggtaagttttagatggttaaggcaggctaactccagtgccaatttttttcttctttctttgtttttttatcctaattttaaatccttcagttcccttttgtccctttgttctattttggtcctaaaagaagcattcatctttgaggccagccagggaatctccaaggaagtgaggtctgtgccgtaatcctaaaaacaaatggccaccctggagtctgtgaatttccacgttgagctctattcaatattgttgggggagatgtaaatgaatgtggtaaatatttaatggaatgctgacatgttgagtccagacctatgataggtgggcgtgtagaaaaattagtgcctaaccagctcaataagtttacaagcatttgtagaagaggcaaacaattcttgtctgccaaacattatttaaaaagaagacgtggagggtggtaggttgatttcaggtcagtgtttgtatgtctgggtctgaatatagtttggagactgtacaatctgtttggcatggctctgcagcagtgggatttctctggaaggatattttggaattcttgttcaccacccaccatgcttttcctgggcctcagaagagatttcagcatcgaggcgagatttagaatgtgggcacctgagtgttggtgccagctccttagtagatttccagggttccttacttagcaattacatcaacatccttggtcatgtgaagcaggcagaggaaaggaagtaggatttgggatcgggcaggtgtggctttgactgccggccctccctgctcaagttgccatgaatgatgtaaggcctctgagttctaatatcctcatttgtagaatggggctattatgagtaccaataccatggacttgttaaaagactggatgagtcaaagtgttggagtgcttagaattgtgtttggcacatagtgagacctaggaaagggtttgttaaaaaattaagcagaacatatcttctaggactgccttttatgcaagtgtacgtgtatgtatgcattaatctgtttttttgaaagttaccttttcttaaaaaaattaattttattgtaagttgcaggatacatgtgcaggatgtgcaggtttatcacataggtaaacgtgtgccatggtggttgtctgcacccatcaacccatcagctaggtattaagccccatgttcatcagctatttatcctgatgctctcccttcccccaccaccccctacaggccccagtgtgtgttgtttccctccctgtatccatgtgttctcattgttcagctcccacttgtgagtgagaacatggagtgtctggttttctgttcttgtgttagtttactcaggttaatggcttccagctccatccatgtccctgcaaaagacatgatctcatccttttttatggctgcatagtattccatggtgggtatgtaccacattttctttatccagtctatctttgatgggcatttgtgttgattccatgtctttgctattgtgattagtgctgtatgcactaatcttacaaccacttttgtactagtccagaatctattagttttaatggacagctacccaaatcaaacttgcttaagcaaaaatggggatttgttgattcatgaaactgggataattgaaggtcagtcggtagtaagtgaatcatcatttaaacgctcagcactctaattgagatataaacagatgtgattgtaagaaacaccatgaataaagctcaaacacttacaaatgggtgcaagcccaaagaatattttaagtatgtggttatattacttagagcaaccgcacaacaaccctgtaaggggagtgttattgccccaaatttataagggaattaattgaggttcagaaagtttaagtaacttgcccagggaaaaacagccagggattttcagagcccaaatttggacccaaacttcttatggcttcaatagctgagttcctgatcaatatgatacattgctattacgataaaaataagtactttttattagtaaactggagaccagagaaattatctatctatctgtctatctatacgtatacatatacatatacatatacatatacatatacatatacatatacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctcctaagtagctgggattacaggtgtgtgccaccatacccggctaattttttgtgttttttatagagacaggctttcaccatgttggtcaggctgttcttgaactcctgacctcaagtgatacaccctcctcggcctcccaaagtgctgggattacaggtgtgagccaccatacctgtcccagagaaatatgttttcaaaaaacaaacaaacatgaaatacgtggaaaggcagcataacatgggattatgtatggggccagatttacccttcacaagctgtgtgattttgggcaagttacttgaccactctgtgtcttgttttcctcacagtaatatgaagatagtcataggatttaccttataggatagttgtgaagattaagtgagttaatatacaaaggagttagaagatgtttggcaaataataaatggcatatatagtttattttaaaatattttaaaatagattgtcatgtaagagccagaaaggaaatgaggtcactcagagtggttcctcttttgatgtccccagggtgtcccacaaggacactgctaatctggggagttgaaaatcccacctgtcagaggctctctgttgccaccagctgcctggccatgacatcgcagagagaccatcttgcagcagtcagccccttggctaatcctctccaatgagaggttcagctgcacagcttggcacagcttggttctgggtccctcacatctctgtcttgtctgcaaaactaggctgtatagtctctgaaaacacagttttatctgctacctccttttctcctccagtgctgtatttggtgggttcccagtgatggctaatacccattcattggtctgataacatattttttcccctggtctgaagctggagaaaaaagcttcagcagagagaagccatctcctgttctgagatgactgctagttatcggacaagggaatgaaagatgtgttttgcacttcttaagcacagacttgcttttacaatatggggtgccttagcacctgccccatgttgtttgaccttcttgccaccttgaaaacctgccccctgccaagctgtggtgaatgctgactggcaggttcatagcgtcaaagtcacagtgctagtaaacacgtcaacgtgatttcacgtgaaaacagccatccaagctgttaatatgagcccgccttaagggattttgactttgcgcatgcctgcccttagtagaaagtacagcacatcttgctacctacttggaaatctgatggacagtcagaagctcctctggagtcctttggtgaatttcacaagagccatcaactctctacaatgatggggaatatttggggagttacatgcgcagttttctgggatgagggcacaattcagagtggtccaatttcagagtggttcatgcctcaaaaataagattgaggaaccgcagtttcacccttagaagaggctcaatggtatgggaaaaagccaaggagaaatcagcccttgaggtggagatgatgcctcagcttcacaaaaaaagggcaacctaataatctctttatctgtcctcctcctgcgttccttccccttctgttttctcctccagtggttattctttcctggtgttccctggtgattagcccatttccatgtacctctgactttctcttgcttgggaggcatttccccacttcctgaagactcagtggtgggtggtgtaggtcagctcttctccagccatcaaagtcttctcctcctctctctgctctttggatttgtattcctttacctctaaggactgttgggatggttgagattgactaaggggtggagagtaaaggagatgaagaaaccactcagattgagttaaaatgtccaagctaagactgggcacatggctcatgcctgtaatgccaggactttgggaggctgagttgggaggatcacttgatcccaggagtaccagacccgcctggcaacacagcgagacccccatctctgaaaaaaagtttaaaaattgccagacgtgctggtatgcacctgtagtcccaggttttcaggagtctgaggcaggaggattgtttgagcccaggagtcggaggctgcagtgagctatgatcatgccactgccttccagcctgggtgacagagtgagaccctgtctcaataaataaataaaataattttctaaaaacccaggccaccatttctcagagtatattaatccatatcgcattcaaaaaaaagaaagccttcttatagtattgagcacaagggagttttgtagttttgtagcctctcagttcatggggatagctctgtgtttgactaactctacggccttggccaattcacttcccctctcatggtctcagtgttcttgttactaatgtactagatggaacagactctacttcataggaatgaagaggggataaactgagataacagatacaatgaaatgagtactgtgtctggcacatagtaagcattgaataagtggtagtgactctgttagtgatgatgaagaagatgaagatgtaggaggaaggaatgaagaagagaagaagccaaaagcctagcacaggtctgatacataattctcaaaaagcagataatccaatagatagcaaaatgaatgatgagtggatgggtgggtagacggatgggtggatgatgagtgggtggatggatggatggtgtgttggtcatcaaatcagttttggaaagtctggatcaaacaagatccagcagttttttgttttgttttgttttgttttgttttcttctttacaggacttctcaggtgcttttatatgctaatagtcatcatgaattcccaagaggaagacagggcaagctgaatttctccaactcatttgtccgtggtgtcctttttacaatgagccatctgatgagccttctatccatgcaaagtatgccttgcaagatgccagtccagcacacttagcttctaaagagaaaataataggcagaaagctcaggtggttcagccagttcagcaactgaatggaattagtacaaaaatcctcatttaccagtcctggagacctgtgctgttaggagtggcctctgtgtccagctcctgtagggtcctggagcacagaaggcagaagatgtagagagtgcacaaagaaaagtccagcggagtagctgcatcctccccccttctgagaggcctcagggggtatttgtttgcctcaagcaaggtcaacaaattctcaaacccagttgtcattcatccccagacaggtcagaggtcggttcctgaggcattgttgatctcagcagagatgatgtgcagggttgatattcttagatttgctcattcagccagtcagtctggctttcagaggagaatcaggtcaggaagcgcttaatgaaccaagaggagcatggtgctgcctgaaccactggggatttgagtttgtaatgactatcagcaggctcctcacttacaaaacctactggaattttctttgtgcatctccataaccatttttagagatgtggttagtactgctggttagagtaacccagggtcctggattctttaagttacttctgatttaaaggtaccatcttcatcatccctaaaaaccataaattgaacttgatatcctttttactgttttggtttcaaaaattgcattttccatttacagaagccatatacctatcctttgttaattcctgggtcttagttttttgtttgggacatagaagaaggaggtaagctcttcaacaagaaggcacttcacaagttgcatttgttagcacgctttcatttgagcaattagcggttgaagggaggaagagttttgatatccctggcttgatcctccaaccagctgctaattctgttgtcactatgacaactatcaacagccatttactgagtgtttgctatgagcctctgagctaaacactgcagtatactgtacttatttaaatctctggaccactccatgtgttatggctactcgtgatattcttatttcgcagataataaatctgaggcacagagaggttaagtgatgtgcacgggaacacacagctgataactggtaggaactgggcttttaatgtggtctatgtggtttaatgtgagctcttaactactatactatggtgcttgcaacaagggagccaggcatggtaagaagttgccaggaggtgagagaatgtaatgccacaagaataacatatgcttagtacatacttgtcattctcataagaacttcccatggaacggctcatttgcatacactaactgaaagcagtctctaagtggggagatgtgacttctcttctccgggtgtctttttttgctagattagtcctccactgagatttccaatgggggtggttgtaatctggagagaggttggttgatggtctggtgtatcctgtccacagtctatggaagcttttcctatattcccatcttgataatttgatgcggttgtgacttgggtgtcacattgacaacccttttgtagccatcctctccttcactgggaattcatttgttagtccttggtattctaaatattatgtagcatctcagggaatttttcttgcggtccatgctaggtaatgcttttccatgttctcttctcacctacgctggatggagtttgagtgcatgtctggcagtgagtgtcatttctcagttctggttcaagctgataccctagtgtcatcattcttgatgactcagcaggtattacaggcatgtagggaaacctgactcttggtaactgaccaggcacacattctgttgtttaaccttggacaagtcacttggactccctgcgcctctgtctcatcccacaggtaacagatcattctcaaatacttattgagcaactactctgtgcccagtcctgggtgaatggcaggcaaacacagggattgaggaggtggtggaggggatagaatggaagcacacctgtgtgataatgccagctaggcctttaccatcccagggcaaatcactgctgatgtttcagaatctcagccccatagatcacgagtgctgggattggagcaggaggtagtgctgggaagacctggcatatgactgcttgtggaaggatgggatgtatatataagcagttttactggggggataatagaatggaagctcgaacagcaacatctgtatggggtgttggtggggcactgaagacagacagagctgccatgatgagcagagagatgaaaaaacaattttgaatgggtgcattgaaaacattctgaagaatgaattaaaattaactagcactttctggatgccttccaagcaccaggaacacccaccttcagcatgtcatttcactgctgtaatgcatttatgagagggtacaggtgttttgtaccatcttagccctgatgggagtagggctcaaggatgagtatatcgtccttaatcagaaacataaaagggcgacagagcccagatcccccagatccaaacccagcctctccaactttgaaacgcaggcttttcctactgttgtgatgccctcaggtcacttgtgatgaccttggaaacataggtagctctcagtggtctgggggcccctggcagcccctccaccttcctcacactttttcagtcagtcatttctggaaggatttgggaaaacttcatttgctagtggacattttagtcattgggtgagcaagaagaaatggcatacttccttatttgagccaatctgccttctcaaaagtgtgatcactattaaaagagtcatgatatggtgtgggcagtctctgaaccaaacacaatgctgaaatgactttcggacaaaggtgatggtgcacttagttctgtcttgggtggcagggacaactttgcagaagctgtcatggaacatttgacttaggccaacaagattgatctaaaaggaagaaaggaagagaggaaggaagggtatttctgcatagcaggcaagtttaaatggaaaagtggattcacagaggtatttggcaaagataatttgccagtgtggtttgaagaaaagagtgatctgtagaaaaacggaaaatttgtatcggaggatgaatttggacagggtaaagtgaggaatattatgaagggcctcagatgctgtaggaaattttccattacccacttttgtctggaaacaaagtgagtgattgtgtgagtaattacataatctgcacaaatctgtattttgaaataaacattgtcaatatccaaaagataagaaatgtgatgataggatcagggaaacactctgttttatgcattttgttttgttctgttttgatagtcaacaaatggcaactgacagcttctttttagatagctttttagaaagcaaagaatggttgggttgatcctacagtgagctcctgacctgtgggagaggcagctttttcgcagatatgattattggtacaaagaaatgtggctcaacatgcctagatcttccagtgtttcaagagatagcataaatctagattttatatgagatgcccccattaaacaatattacctttttttttttacactgtgcagacaaatcattatcatgatcatcatcatccccttctgtggactggacttggtccccacggctgcaggttgcgatgttgaccgacagaatccatgaggcaggagttggtcttctctagataccccctgtctctcatcttccagacacagccaacacttctgtttcttccttctctttcattgacgtctaaactttgagaggctaccactcagaagggccagtcacttatgttggctctctttgttagtctggtgtcaaactcctgggctcaagtgatcctgctgcctcagcctccagagtggcggagactcaggtgtgcaccactgtgcccagcttatgttagctgttaagatctgggaaaggaggttctgggcgcggtggctcatgcctgtaatcccagcactttgggaggctgcggcaggtagatcatgaggtcaggagttcaagacaatcctggccaacgtggtgaaaccctgtctctactaaaaatacaaaaattaggcaggtgtggtggcggatccctgtaatcccagctactcggcaggctgaagcagaagactagcttgaattcgggtggcagaggttgcagtgagctgagatcatgccattgcactctagcctgggacagagcgagactctgtctcaaaaaaaaaaaaaaaaaaaaaaagaagacctgggaagggagatgcagtatctgacagccagagctaaaatgcctttatctagaacaggaaaagaggagttaatacctaagaaggaaatgtcatcatggaaggtggagatagatggaagaattttttttttttttttttaggtggagggatgagattgaactatcaaagcctggctaagaaaaagcaaaatccttgatggaaatctctggcacagggaaaatgagcagaactggcaccaaggaagcattaggagagagaagaagatagtggggaagcagaaaggaacagcaaaggagcgagtatttgccattgtcttgaagtctgacttcttggataaaatacataccctagattaagggttagcaaaccatgggctgtgagcccaacctggaccattgcctgtttttgtataatcttcgaggtaagaatggtgtttgcatttataactggctggaaactttttttaaaaaaagaataatattttgtgacctgtaaaaatgataggaatttagtaaatacagtattacaggaacatggccacaatccttctttggtgtattgtcaacggatgctttttcacgctacaacagcagaattttgagcagttgcagcagagattgtaagttctgcaacacctaaaatatttattatctgagtgtttacagaaaaacatttaccattccctgcccgtgatgggcagagcagatggcaatacacggctctttatttgacttccgtatgtttcagggatctgcctgtttcttagccactaccagaactgccccactctcctttcaccttgctgtttcttccactatttaaagttcctgcattacaccgtgagcgtaataccacataatagatgttgagtagcccgacatttgccatgaaccatgtgcactgccactggggaatggaaagacacacgacatagtgtcgaccttctagaggaggctccaagaaggaagaatcacagctcagcaatactaggtgcttcccatttgggagagcagaacctatgttaagaaaaagaggttttgtttagtagttgttatttatttacaggctttatgattagtggaaggttttgaacgaggacgaagtcaatacaacttcaaaaacataagtaccgcaatcatacaggacaataatatataaatacaaaatcagaatcagagaatgtatgagtaatggtgatcgcgactggaggtgggagggacagcccttattttcacacaagataaggaagatatttgtaactcaagaacagcaaaaggttattgtatcatggcgttcttaagaagaaaacagaaaatatccccggcacaaggtataactatatatctctatcctgtatgtaatatatctcttatttctatcctactaaaatcagcagattcttttatatataagcatatatacacacagtcacgtgtcccttaacatttggcactgggtatgttctgagaaactggtcaggcaatcttgtactgaatactgtaggtgattgtatctaaacatagaaaaggtacagtaaagtataacattataatataatctgatgtgaccagcatgatatatccaatttgtcatggcctgaaatgccattatatatacagtcatccctcaatatggtgggagattggttccaggacctcccctcagataccaaaatctgcagatgctcagtccctgatataaaatggcctaggatttgcatataacctatgcacatcttcccgtatacatattaaatcgtctttagattacttctgaagcctaatacaatgtaaatgctgtgtaaatcattgttatactctattgtttaggaaataatgacaagaacaaacagtctgtatatgttcagtgcaggtgcagaggttttttttttttttttttttctgttttagatgatctgaggttggttgaatctatggatgtggaaccccagaatatggagagctctgtgtgtgtgtgtgtgtgtgtgtgtgtgtgtgtgtgtttgtgtgtgtgtgtgtagagagagagagagagagagagaaagttacataaatacaatggatcactatcttctctgcagtttccagctacctcttcctcaagtttgcttattgaagcattcttgattaagagtaaggggatatagttacctctcttctatgctcaggaaactaagagtctaaagctgtaaatttgttgcctgaatgatggaattaagtctcctgccttctggtccagtggtctttctattttacaacactaaagagacaatttgatctgacacaggccttacctaagtaagtaagagctctcccctcctgttgattgctaaaggaaagcagacgggagagacacgtccgtctcacagtgatgcttctgtcctccccggtaacttctcagaaatgtggtgttgaaagtcatcgtcaaaagctaaagttagaaacagtatcgggctgttgagtaagaggggtcagtgcgcagctgttatgggagctttttgaattgtacaacgtggccactttgatgcatgagaatcaattacagagaaaccttgtcaagatggccaaaattcagccttaaataattgaattctctgccaaaccctgtccgccgtcgttatctagaaatgcaattatgcagctaaatcaagcaactaaaattagtgtagtgtaaaaacaccttggctatctgaaagtggaggaattgacatttggatttagaaaacgccaatagttggatatgtttggcggtgtttgaagctctctcccagtttcaacaaaatctatatcaagtgtcctgtttagagtgagcagtggaatgtggccagtgaatgtttcattttgaaggtgattttcagtgattcctgggacttgggcattatttgagtggattcacttcatcagaacttcatattattgctttcaaaattgtggaactacacacacccacatgtctttctaataagaagattagaagactgacaatttgattgttatctgagccttcagtctcaggtcaaagccttcaatctgaaaccaaagatgtgtctgtaccaatcatcaggaaaacagggaatacatgataaaagtggctaatagctgccggtactgcacacatcatgttatggttctaggacttcatttaatgataacacagccttttgaagtagggactattattatctcagttttccaaatgagtgaacagggttcagagaggctaagtaacttgttcaagatcacacagctagtgattatactgacacccaagtcagtataattccaattatattaattaatatattaattcaattggaattaattccaattcatgtcatcccctaggaatttatctgctcctatgtaacatatcccaaatgattgcttgggtattttcaaacaccagaaagatttcaaatctgtgcttgaatgtattttttatccatagttttggtgcttgttagctatgccttgaaactctgagaacaagaagacatctcttgttaatgtattgcatattaatatatcacagatgaaagctcaaaataaagaatgtcgttaaaaacacaaaataaaaggcatagaaaatgttattacagactgaaatacagcagtgaaaacagtgttgtggttaggaatcgggctctggaatgtgtttgtagcttcgcactgccttgtacgagctatgtgaccatgagcaaaccatttaactagtatcagccctgtttcccatttgttatatgggactgataatagtactgacttcagagacttgttgtgagaatgaaattacataacacgtgtaaataatttaactctgtctctctgcgtagcacacattgtgcaaatacaagctggctggtagttttatcttatttacaaattgccactttaaatttgaaatcagagagagagcgggaggaaaactagactgaatatcttcttattttttttctatcagtgccaaacgttgcccacattaacctgctggatttgaattttaactcggaggcgataatcacattaatttacatttctcagtttatttttccctaaaaatcccatgtagaccccatcccttgctcttttggccaaattcagtaggatgagcttatatctcatagcctggttccctctgtcacttggtctcttggtctctctctctgtctctctctctctctgagaactaaattaatgaagagtatttggttagtcatgttaggcaagctgttcccaaaatagcaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcaggtaattcaaggcctctgccagccagcaacttaactccagagtgctcagagtaataattggaatttttatggttgagaaagcaaacacttttaatacaggaaaaagccctcgcgtagtcagtgagaagacagtaggaaatcaaaaagatggatcaccctaatctagctatcgacatctctcatggctgaataaatggtgtagttgagctatatttgcttgtattgatctgactgctatttaacattcatgtcttagcttcaggaggttgaccacggggcaaaggatttgctctccttctcagctttctgagggactcagtctcccagagcagatcatgagacaaagtaacttatcatgaggtgactcagttaagagctttaacccaggaaatgaaaggagcatgaaatatgcattaattcataggacgcctccacacggattgtctattttcagagaaggctctccccacctgaatttgagtggtggcactgaggcaagaaggaacactctattgatgggtaatttatgaagctcagagattattctaggaatcccttgccagatgtgtacatcttaatgatggcaagaaagtggagggttgatatgtgtgctggttttactttgaagtcttttaattctgtgcagagaggattaatctaccaataaacaattggggacctttttttttccccctcatcataaggttttctttgcaagcaggtattgccttccgcgtttatgtctgaagttctccgttgaaagctaacatctactagcgatagaacccacagatcatagaaatccaaggtggctttttgttgttataattagttttttgagtataatcatccctttgcaataaattctgtatctcctttctacagaaaaggaaaacaaaatatatttaggtacgtcctttcacctttactcctgtgcctccctctgtcccctccagcccctcatagttaaaaactatatgataccctagctcattaattacaatttctgggaaccattctggtcacttttccccctacctcttctgaactttgctgttaccttttgttaagtgtacgaacctgggtgattagagtcatctgggggtgattccaagtcacaacaaaacattctctctttctggatttatggccgttcctctgtttggaagcttttctctgtattacctgttataaacaaatgggtcatctggagaacggtcctttgcagcgtggaacttgttgcgtcttccctggtatacacaggccggtatgataaggttgccatttctgaagtagggctcagtggcaacttagaaagttaacaggcctgttgctgctactggaaacgtggggtgaaggtcggctgttggagctttgtcagaccctctgccgacccatctgataaataattacaggcaaatcgtggccttcactctatgctgattgatgctgaaattgcttttgaaagttctcataagttcctgttatagattaagtgccggtgtaggaaaaataacggcacccactgaaatgggtgaatgtaatcaggtttaatggactccagagcttgttgggaattaaataactatcgatttgttggaatgttgctgtcattacgaaatgccactctggacgtattaccccagtgatagatgagaagatgcaagggccagctgagaaattggggaggccctatttcttcctcctttgcagagcatttgagaaacatagccagttatttttggaaagaacaagtggtcttacttgtaaatcttagcctgatcatactgtgtttttccaagcgacacctctggtaactagttacccataagttaggagagcagtttagtgaggagcctctagaccagctgctgtgatatgtgttatctcctttctttctcactgctgtggaatgcactggaaagctaacacacagagagaaactggctttacttatggtttgctgagacagcccatgttatttaccctttggcatcaagtagctaaaatcaccccagtgcagtaatatttgcaaggggagaaagggcagtgcaaagggagaaaaaactgtatcactcacagatgctcagctctgagccgatgtttctgctgccagctgtcctgcattgctgcagactccacttgctcactagtttcttgaccttatgggtttcttcctcactcaggaggcaaagtatttcctctagggaattaaggttctatcaccacctaaatatgtcattggcaagatgttaaaatgagccaaaataaaccatgtgtactccatcactgggagtaatttctctgtgactggagatgttgaaacagagttcatagtgtccacttggaaggattgttgtattatagttggagattacttttcaaggtctttccaacctcaagagattttgtggcagagtgctcccttttcatattttcaagagtcattttgaaaattcagaccagcatcgccctgttttagttgcctcagataaagaaaaaaaaaaaaaaaaaaaaaaaaaccaagtgatttaccagtcatttggtgtgccagactttaagacggcatccacctaatcctgcaaaggcagtggatggaggtatttactgatagcttcaggaaagttactcatacaggatcttttattccaagcaataattgatagttatcatctgccctacccttcctcctttaggaaaatcagaatctttatcatattggatctcctgaacccattattttatgtctacacttgttgtgtgtagccaaatagagagtttttccctccagccaggtagagaatgacagaatgactatggagaattcagctgaacctgtctggactgtctcatgtgcagaaaaagcagagaggaaaggataagagtagtattcccaagtgcattgtacaaatattggctgctttcccccttgatagagatcccgatgttgatatctttggataagaagaaccaatgtactacttaacactacttatttctgaatttctagtgatgccttgaatgatcagtgaattgtctgacctggtaacacaggagcctcagtcacttgcccaagtcagcctcgagtccagaagctactcagaggtcttagccaagccatggaccatggccaaatgacataaccaaaacaacagctttgtaactggttaggctatttggttagtgtttgggtctaatgtgttggctctgggctgcaagtgtggaccctcacccctcaatctaggtatctacctcatagatatgcccttgggccatacatggccaagtcactttcactattggacaaatcgttcccatttcatccaggtctgacagatgatgagtcagcagattattttcctggatggttgatggtgtaaatagagccatattcacctcatcatgcatttgttccttcagttatccattcactgtatactcaacctataacaaaagtgacagtcatagccactgaactgtgggttcacaatctagtggaagaactagtaggtaaaccccaactataagactataatgaagtcagagggaggaaatgataggtaatgattgttgaacacaatattgtcatgtgccaggctctgtgctaaacacttagatttaggatctcaatttatttttataataaacgtaatgcaattgggcagtatttgtccaccttcctatatctgtaattgtaaattccaaaaagctctgaaaatcaatttcttttggaagttgggcaccaaagctcatttaggaacagaaacttgacctgaaatgatgtgtagctatttatagactttctttatcccagctaatgtaaatattcatgtattttgctgtaggaatatttatgtgtttgattttcagggtgttgtcctagaccctgctgagggctttacataatcagcatttccactgaaataactttctgaaaaagcccccaaaatctgattttcaaaatgctggtgactccaacgggtcttaggtaagaaattgcagtcatgcctttaattcccctttgcctatggagaacctaaaacctacacttagacaaagctaggtagcccaaggtcacaaagaatgcgagtggtatagctgggatttggactggatttgttgaaccagggtcttttatccaccaagctaccctctaggttgaggtattcaggcagggtggcttatgaaaacacaggaaaggaagtaacccagtgcctcttagagtcgggaagagggtggtttcaaaggaagggaactggtatttgagttgggc[450 bp omitted]agtaactgggattacaggcacgtgccaccacacccagctaatttttatatttttagtagagacagggtttcaccatgttggttaggctcatcttgaactcttgacctcatgatctgcccgccttggcctcccagagtactgggattacaggcatgagccaccatgcccagcctagggctggtgaatgtttaattttctgggtttgtgcatcatttaccattcctttctcttttaaagtattattttatttttgtaagttccagggtacatgtgcagggtgtgcaggtttgttacataggtaaaggagtgccatggttgtttgctgcacctattaacccatcaccgatgtatttagcccagggtgcattaactgttttccctaatgctctccccacccccacctaagcatggcaattatcatttaccgtttctatgccttcttttctctctgagatggtaagctctcagagggctgagatttttccagcctaaactttctatagctagacagtggcagaaaaatgccaatgtatgcctctctgacgtggatagcaatggtttaaagaaaccctatactccatgtttttatttttatttcttttagagaaagggtctcactctgtcactcagactggagtgcagtggtgcaatcatagctcactgtagcctcgaactcctggtctcaagtaatcctcagcctcctgagtagctggaactacagacatgtaccactatgctcagcttttttaaaaaaaattcttttgtagagatgaggtctcattatgttggccagcctggtctcaaactcctggtctcagacacacacactgtattttgaagcagaaaccagcgtatgtattttatgagacatctacatacctatatgtagtaacaatgcaaattatagaaacatcggccttaacaatggacagagagtaaccatccttatagaaagataaagaaatctataaagaacttacaagtaatttgggtaagtttctggttgaacttgaaaaacaacagcttgtttggctctgtggctggcatttcaggtcttgatattgctgccctgcgattttatctccatgtttggaatgtctgttgattgggaaagacatcagcatgcacacctgatataaatgctggtggcgtcatttactctgaggctgctccatcttagtcactaagcggacttttctgtactgccaaagaggccatgtcaacagcggactaaattaaagagtcagggaggtggcagagagaatttggagtcaaacaggtccaggttgatatataggctctggcatttactaagcctgtggcctgaggcttgtcaattaacctcaccaagcctcagttttctaggctgcaaaacaaaagcaggaaggcctagcttgcaaagtcactgtgagttttcagtgtgattcatcatgtgtttattcagcaattatctattgagcacctactgtgtgccaggctgtgaactaggactaggtgatgtggtagaatagaacacactctagatctcttccaacaggaagttgatattctaacacatgggaaaagctagcatataaagtatgtttattctgtattattctggagagagaaggagagaggaaagatatttatgtattattattattttgtgacggaatcttgctctgtagcccaggctgtagtgcagtggcatgatctcagctcactgcacctccacctgccaagttcaagtgattctcctgcttcagcctcctgagtatctgggaccgtgggcatgcaccaccacaaccagcttatttttgtatttttagtaaagacagggtttcaccatgttggctgggctggtcttgaactcctgacctcaggtgatccgcccacttcagcctcccaaaatgctgggattacaggtgcaagccactgtgcctggccagaaagatatttgttaagaattcttttgtctgcgatgaagaaaattctaagtcctattggttaaagggggaaaaaaagcatctagctccagcttcaggcactattgaattcaggaattttgacaagccaagggctgtcactctccacctctccacagtggttatctctacttgatcctcactcacaagcacaccatgtccaagtggtggaaaagatggttcttggcaactccaagcttacatctcatctccttttagaaattctcttcccaactattccagcaagaattccagattgcagtctcattggtagatcttatagtccatgcacatctccaaatcaatcatctaatctctggttgcccactttagagccagagggcagggtcagccccaagaaagctgcatagactatgaacggaggccagatcagggacctcttaccaaaatgtgttggtggataagcaaaatctaggttcttgttatcaacaacaattatagttaaagctgtcacagacattcaaacctgtgctttctcccccataactttgcacacaccatcccctggggagcaagtggtgggtttcagatcttaattatcctgatcacttgttgccattgatcatatttactaggtagttttattgccttccacttcacttggcttctccattcatgatcagatttgccaaaggcagggatggctgttttacctggtatcttctccgttgcactaattacagtcatgtcttccactcgtgtatttgggatattccaactctttttacagactagtaagtcacaacctagggaagtcaagacagtccaaccaggacatccaacaacacaataatcagtgcaagattgtgtttctcagattcatgatccatgcagccacaccacttctcttcacatcagtgatgcataaataaatatattaaaaagagcaaacagagccttccagttattaactttgtcatgacgtagacctcccatcattccaaagcactcgaagatgctagtgacttgtcctattctgttttatataaattcacttttttaaattaagagattaaagggacactgtcaatctcttctgattaatatcagtcctataaaaagggtgtcttgctgcagcagccatctgtcattttgatcattttaaaggcatgctatatcagcaactatgctttttataatacgttggcacagggcagggagggttggaagacctacggatttcacactctctgctgctgctttggtgttcggcaatgtgagcttttgatggtggagcagagtcccctccctgtcttttaaaggttgttttgggtaagtgcttttcctgggtgatttatgatggagatactcacccctatttatgtttttcccccgtctaaagatagacctctcacacacacatcccaccagcttgcaaggagccagcatgttcacttgattcactgctgagccctaagagatgcccagaaacattgaactcaatactctgaaggtcttttcctctgagcaaccgagaccattatcttcagcaatggtcactgtctagattgagcttttcaggcttgtaaaactaggaggcaaaggctccatgaaactcattcatttattaagataatgatttatcaatcatagatttcgtgactgttgtcttgcaagctctggaggtattgggatgatcaagtcccagtctccgtcctcagaggttgcgtaggggggccatgccattcgcagtagagtcagaggttaagcacaactgtttgaagatagaactcttgagtctccaccccactgaccgactcagtatgacgtcttcattgctgtcagtggtctgacactcaagacaggtttatgcacagtccaaagaagatggcttcctacagagagatactccaaatgacagagttcctgctacatttcagagaacaatggtcctaccttccttccttccttccttccttccctccctccctccctccttccctccctccctccctccttccctccttccctccctccctccttccttccttccttccttccttccttccttccttccttccttccttcctttttgaggtgggaagatgacagcaggagctcctgcccccggcccccttcccaccttgcatccaacttagactaaagtaatagagttcaacacacccactgctgtgggagaaggtgttgcttggccattccttctcttctgctctttaatctgtattggctcctggaggaggggagaattgcagtgaggagggggatcacttgttcattccacattgttctcaggaactgctctctgaagacctatttcttcttatttcctgaggcagcacagttaaatttgaaaagaacaggatttacaacaaggaaacctgagtctggccattactctctctgtgttactcttggtaagttgcttgacctctctgaacctccacttcctcatctgtaaaatgggagtaataccaagtgtactctactcacaaggcctttgcagtgtagtcatggtgtcattagggcagcaagacaggatgcctagggctgggcttccaactcagatcttcccactcagacgcatctgagttggcatcctggctcctgtgtgatgcggggcttcagctctctgagcacccatggtttcaacctgtctgcggggatggtcacatcgactgcagaagggagcaatccgatttgacaatcagctcattgtaccaacgccacaactgattgccagcagtgttgtcttggtttgttcatgatttctggagttattgaatgttcattttgataaatcgagatgctctaggttgggaaaggagaatgtttacacttctctgctcccattcttggtggagattcctggtgagcaaggacacatgtgtttggcctgcgtggacagtgcagagatacaactggggaggtggcgaaggagagggagagatgccaccatggagtttgacatcttggctcatggctctgggtggtgtgaaaccaccatcctctttccacatggctggtataaaagccaccatcctcttcccactccctaagccaatagcctgcatagttggaatgactaagtcccagcctctgtcctcagaggttgcatcagggggccatgtcattctcagtagagtcggaagttaattacaagaaacacgtgaaggagagttgatcagtttcaataatgttgaatccttgcccaaatctttgtccagaacatgctgggactggaactggagctgggttgcaggacggggagggtggactttgtagggggaagagaggcctgtcccctccgttccatgtggccatagccttctggggacagactctttaggaccacccacacccctgttccatgcagctctggcacaccgtgggcgcttaataaatgttaaataataagaatagctcccatctgtcagtgcccggtggcaaggaggatgtgtgagtgccagccgtcactgggcagcttatgggaagcctttcggggggaaattgtagctctgagtcgcttcgaagtcccgctgcatccagatgttcccccaaagctgctatggatcagtgtccaggcaagggaggagcatgggactccagaacatctgcatcagagtgacagggggcgggaccagagagatgagaatctgaccagcagtgggatttgggagctggtattgaccaacagtacaagggctttgttgaggtttaaaagggctagaggagctgccctctgagcacacagcagcataaattcatacttccgtcatattcttggaagcaaatgccaactgggacttttcagattttgttataataacaacagcagctgctgtttttaggcatttactatatatgaggctgtgtgtgaggggtttcacttgtcgtacctaattgaagtaatatatcttagggaggaaaaaacaggcaaacaggaggtggtatggagtagggtgtgagctctagagcagactgcctggttcatctgctgcaaccattgaggcctccacctctgggaccttggatgccatttgctacctgtgtgaccttggcacagtttttcccttctgggcagtagtcaccctctttgagtggttgttaaaggaaccaaatcatgtaaagtccacaatatagcacctggcacatagaaagtcctcaataaatgtatttacaagtttatttccaagcgtaaagcaataccaccacaaccaacaccaatgcaattaaataatagcctcaatcttgagtgttttctatatagggaagccaataccttctactggctaagagtatgagcccttgagccagactgcctgggttagaatctcagctttactttttttttttttttttttttttttaactcctaagctactctgaactgcagttttctcttcggtaaaatggcccatattaaaagtgcctaaattcaagcttcgctgtactcttctgtaggacagggataataccaaagtcatttctgaggatcaaatcaattaatactccctaagtacttaaaatagtaaatccaatatagtcagggctaaaaaaaactgatagaaataataattgttacatgattattttatattttatattatttgtattatgcattattcataagatataatgcaatatatatttcaataatatatgcaataatatgtattttatgtaacacatagttataaatatataaatatataactacataatgccatatagttataggataattatatataatgattagatgacacatatcattgtgtaatactgtataatagttacatagtaatgattatatgtaatataaatgataataataattattatttctactcttgctactatgacaagttactccattggggattttttcctaaataatttctaccactttgaagcattctggccagacttattttaaaaggaaactgaggctcagcaaagtggaacaatttgccctcattcttaggactggggaagggcagaccagccaggtgtctggctgcagagcccgtcctcccgcagaccacacaattctgcaaagctttggtgtctgtcgtctccccatcctccatggggaaatggccatgtctcttgcccgtacaaccgactctgagcagaaggctaatgcgatattgtgccgctgtcatttctgatcagtttttcccccactgtctcacagcgggctgtcaggaggccttgttccccatggaagcctggctcctcgtggagaagatcaaacctggaggttgtgtggtgacaaaggctgaggaagggcactgctgggactgggtcttgtggctctattttcaagacctttatttttggttatcagtgttgaaacctggaaatacactttctgttttccgtttaaacacaaatcaagcaacgttaccaacacacattctctgtcaaacatgtcagttactcccggggctgtggacagcttgcaagcgatgtcttctattgttactgtggtggtgtgttatttctccctctacagctctgcatttgttttggcgagcagtgtaaacactgaggggcctgctctcggggaggttttgacagaacatgtgaaattgacatggaccgtccgatgaccatcttaataaggctgttcgggcagccctgtatttgcctgtagcattttccatgaattttggtgggggcttaaggattctaatgagctgggttttgtttcacacctggtgttttggcagacagttcccactgtgacttagcagagggacttggcacggcttgccagagggcctaagatttgtgtgggcgcccagcagatgttggatgtgttcacccatcatacagaacgccagtcatcagccgccgagtcccctctctgtctacattgtaagggaccagagctcccacttgctgccggtgatggagccgtctggggatggataaaaagcctttcattactgaggataatgcagagcatatgggattcttatctgtccaaacagttgtgggatttgggttagagacgccgtctgcatgtgtattttctttttctttttttaattttaattttttgtttttatttttattatactttaagttctagggtacatgtgcacaacgtgcaggtttgttacatacatatacatgtgccatgttggtgtgctgcacccattaactcgtcatttacattaggtatatctcctaatgctatccctcccagctcctccaaccccacaacaggccccggtgtgtgatgttccccttcctgtgtccaagtgttctcattgttcaattcccacctgtgagtgagaacatgcggtgtttggttttttgtccttgcgatagtttgctgagaatgatggtttctagcttcatccgtgtccctacaaaggacatgaactcatccttttttatggatgcatagtattccatggtgtatatgtgcgacattttcttaatccagtctgtcattgatggacatttggtttggttccaagcaatgcccctgggccacatgggacacacacaccatgatgtgtcagcaacgagacgtctatagagtaaaccacgatggcagaggagcattctacccaagagggcagtgtattttctttagtatttggttctagcaagtaggagcttcattaaggagcattttgtacagttccttcctgggaatggacacgacacgcgtttgataatgtctctgctttctggcttcacaccttcctcccatgttagcattggttctaaactcccaagcacagatgttaccaagccactgccctcctgtgtagaatgctcctctgccatcctggtttactctatagaagtctcgttgctgacacatcatggtgtgtgtcccatgtggcccacgggcattgcttcgttcaagcctttgtgttcagatctgccctgttatcagagacaagttgatgtcaacttacctcttatctctgatcaataactgttgggcttcctgtgggttgactgaagacccataagattcatgagacccatacgatcatgtgggttgatgatctccaccattctgaatctcaagaaaccaaagatgattcttgaatgtgtgtttttgttaagatccctttggctgaaggaacagaactcaatcctgtctagcttcaaaaaaaacgagaggggcagcatttatatgtttactgtgttttgaggtgtagtgcatgaacaattgaatgcacagaaactcttggactcaaaagagaaagaaaaaagtcaagccaaggaaagcacaagaggtaagacaggcctagtgatctcagcaggcagaatttatggacatattttgcaggcaagtggttctcaatcaggggtgatttttggcttgtaaggacatttagcaatatctggacacattttttggttgtcgtaagtggatgggggttgctgctatcatcctacaatgcataggtgcattagtctgttttcatgctgctgataaagacataccggagactgggcaatttgcaaatgagagaggcttattgggcttacagttccaggtggctggggagccctcacaatcatgttggaaggtaaaagacatgtttcacatggatgacagcaggcaaagagagctcgtgcagggaaactcttgtttttaaaatcatcaggtttcatgagacttgttcattatcaggagaacagcacaggaaagacccgccccccaaattcagtcatttcccaccaggttcctgtcatgacacgtgggaatcgtgggagatacaattcaagatgagacttgggtgaggacacagccaaacgatatcaagtggacacctggaattatcgagcattatccagaattatcagtcacgccgagattgaaaaaccccactctaggctgtcacactactgtgactcagctacagagactatcagtctctgcaagtcttcattcaacttttgctttctcagctaggatctgatggacccaacctatcgtatgtctcaatctttatatcagtgaactatgcccgagacccccatgtatttgcagcccgttcaaagtattgctgagtagtcctgggaaagcaggagtaggatgtagctggttgtgagctgttagccattccgagacaggcgtcttgcagggtgtattgatagccttcagtgcaccctatcctgtggctgacactcattcatgctagtgccttccatgcagagctgtctgtttgtagaaagcaaggcccaccttggtgccagtcttaacgagcagtcaattgatttggttttcgatttaagctcgttgcctcctttgacttctgtttaacagaaaattcactttgcaaaactgttttaaaacattgttgcttacttttcttaccataaaattaatgtgggctaaacctaagttttcagaaacaaaaagcacaaacaaacatacagagatatatgcatataccacatagatacataaaccacaatccgctacccaaaaatgcctactacaaaccactctttatgtatcctggatttctttgtggtacatatattttcttccctaaataattcttatctactctcatcgtattcacaaagatttgtaaaacttgcaagcagctgggtttttaataggaacaccttttgaaataaaattaatgaattttttttttttacctcatgaatattttctgttaggtttttaagactaaggtgatgtcttaaacaaacacatattccgtgtcctttccacatgcccctttgctcttatccctctccttcagcccatggcaaggtcgtatatgatatcctaagtaaatagatcaccaaagaaatgacattactttagtcagttgggaaaagaagatagggacaaagaagagaaagtagcaaaacaatcctatagattacagaattacacaaaaggccggttgccgtggctcacgcctagaatcccagcactttgggaggctgaggatggcagatcacctgaggtcaggagttcaagaccaccctggccaacatgatgaaacttcatctctactaaaaatgccaaaattagccaggggtggtggcacgtgcttgtaatcccagccccttgggaggctcaggcaggagaatcccttgaacccaggaggcggaggtttcagtgagccaagattacgccactgcactccagcctgggtgacacagcgagactccacctcaaagaaaaaaagaatgaagagagaggcagagattgatcggctccagtcaaccgggtgagtaggaggcttctgctttcagattttcttgtaaatttcttgaaatggggacattgaaaaatgtgctagttttggagaaaataaaaatttcatgaccacgatggaggtgtggttgctcctatggttctcagaacacaaaaccatctcctagagacccactgaagttcatgctcattttaggactaaaacttgggttaaaaatcaggcggctcaagagatcaagatatcttcctggcagccttctatcacaagtggagactgggagaccaaccagacttgccttgtcagctctcatcactccttctctcaaaccaaacgcatgtctaaggcgcaagatcggttttcaatttaagtgacttcgctttctctcttaaaaactaaatcctcctcctaattcccctaagtcctcaaagtataacatttttcctttgtagattggagaaagaagtcatggatcgggcttgccaatggcattaggatgaggtctgccagccagtccttgtcagaatgtgcacagaaaatttaaaagacttttttttttccaatcagtagcttaccagttaatactcctccctttccgttttgatagctgaccctcagaatcaaaatgaggatggcgacataccacatccgcttgagaggctgaggagggttgggttcagaaagacggatggctgtggcttgctttccatatgtgttcaccgatttagtaaatatttattcaacattcagtgtgtgctagacaatacagttccaggtgtgagtaagaccacttatatcctattaacaggaaaaaataaagcagaaaataaccaggagaatatcagatgctgttagctgctaggaaggaaataaaataggttatgggccaggcacggtggctcatgcttgtaatcccaacactttgggaggccgaggtgggtggatcacttgaggtcaggagttcgagaccagcctgggcaacatggtgaaacctcatttctactgaaacatacaaaaattagctggcatgatggcgcatgcctgtagtttcagttccttgggtggctgaggtgggagaatcacttgaacttgggaggcagaggttgcagtgagccgagatcaggccactgtactccagcttgggcgacagagccaaattccatctaaaaaatttaaaaaaaaaatggttacatggtagtgactgaaagggttattttagatagttgaaacaggaattagagctcagatctgattgacaagtaggtgccagctgtgtacagtcgtggggtatgggaaagaggtctaaggggaggaaaaaagcaaaagtcctgagatggaatgaaatgggtatgtttgagaaatgaccggatggtcagtatggctgtgacacagtgggtaaagagggaggatgaaaaacacaaagtcaggtgtgcaatcagcagccaggtcccattccaccttgtagggcattgcaggcagtttagattttgatctaggggaaatggcaaacccctgcagaatttcaagtaggagaacactatgatctgattgtatcatgttaaaagattcctctggaaagtgggaggaggatggacaaataatctttagtgggacaagatgcaaaacagacaggacagctagtatgcatggtactggtgaagacgaccagtaccatgttatccacgattggctagtgaatatccatatttcatgctgccatttctttgatcttcattgaccggagaattctgccctaaaaagagggcccgtttcagggatgtggggtaacagaaaaatcacagtgttaatggaatgagaggtagaggaccagggagtatagaaatgtatctgtgtctgtgcctgaaggtctggtattttgtgtggcttcaggggactgtagtatgtgtgtttaattgttaatgacccaagaatgcatccaaaggggttacatgcaaacctgcctgagcatggaagatcagtcttgagtgctttattaagtctggctctatcaaagctgtaagcaacatatggtgtgccatgtgcccatggactaggttttccatcacaggacagttctgtcttcgggatggctggttttccttttattttagcagaagtagagaaggccccttgggactggatctctcacttttgcaagttatgaccacaggggacaacttgggagtttggattcagatggaccgaggttccagagccagcctcactcactgttagctgtgatcttgaacaggttcttttacctctctgagcctcagttcattcgtacctaaaatagagggaaacttttctatgtcaaagggtagtagaaaggttattacgcattgactggttagttcattcctttgataattctttagacatgtattaatcaccactacgtgcaaggcacgatggcaaacattaggaacgcaatgaagtcagctttgattctttttttagtggaatttatgttcttgtaggggaaggagacaaaacaaagaataactaccataatgtatatataaactgattaattttagattgaagtgagtgctatgaagaaaataatgtaagagggaagaaacagttaatgatggtgcggtggatcatgatactctgctcttgagctcacatcctttattgtcttgaaatttttcacccattagctcacttgttctctttttttcgcttcctgggtttgccttagagacacctggtactttactctcccatgccctaaatacccatgtccacagggagcagctgacttactgtggtacaaggaatgtgcttttccagattttaggagccacctgtttctgggagtgccatggaaacacacattctgcctctcaatcttcaggcccaggcaggaaattttcagctgtcagcagctgtctttctgatctgctgccaaggagtttccaaccccaaccccaggaaaagcccacagtgaccctcaccagggactttgatgccattttttggagctgaaaaggaaggaggggctcctgcagagtgattcgtgggctcagttcttgacttggggtggctgagagtttccccttaaataatatgtcacgctgtaggcatatggtcttgcaattgcggggtgtatcatttccacttgattgtcaaagcaccccacggcagaaacatactaaaggatctctgctccagatacagccatggctttgcagcatggcagatttgcagctttgaggtggaaaacatttttcagcctttcccaagaggtgaactggatacagctgtgcagtgtaacctaaatctttgcacgtgtctttaaacagggcagaaacaactggccctgtccttccactctgggcctgatgatgaccaagtcggagagaactgaagctatatatcctgttctcagaagttgaatttccccatcttggacagagtagtgtgctgttgtgggaatgcgtagctattgccttactcaggtgaatgtcatctgaagacgtggggtgggtaagaatctgtcaccactaaacgcttactccgggctgcccatcactgctgtttggtcagtccttttgttctagggccctttgcagccattctccaggaagagtcatcctggccttgccttcagaaacaagctcgctatatttcccatgtagttctagaaagaatcctggtgcagggattctgaaggatgcactcttgtcctggatctgcccctcaatgtctgtgtattaatgagcaaattattattattattattttgagacagggtctcactctgtcaccaaagctggagtgcagtggtgcgatcatggctcactgcagcttcgacctcttgggttcaggtgatcctcccacctcaacctcccaagtagctgggactacaggagcatgccaccatgaccagctaatttttgtattttttgtagagatgaaatttcaccatgttgcctacgctggtatcgaactgctaggcttcagtgatctgcttggcttggcctcccaaagtgctgagactgcaagtatgagccactgcacccagcccataccacttttccatatggcttcaggttacaggtttgtgcatgagttacatagtggaaccctaaagccatacctttgaccagttgtctaaagtttttagcaccactactactgtatagctaatattttctttgaatggattcaatttttgtagcctaaattgattcacaaaaaccatacttttcgtctctaatttaactggacattcaccatcactagccataaataaatggtacctattacaaatgcattgatgaccctagctagaatggctataataaaaaagatagacagcaagaagtgtcagcaaagatgcggagaaattggaatgcacatacattgctggcaggaatgtaaaattccgcagctacttagaaaaatagttgagtatttttcttaaaaaaattactcagttattatgacccagcaattctgctcctaggtatatattcaagataattaaaaacatatgtgtacacaaaaacgtgtgtaccagtgtttataatagcattattcatagtaaccaaagcatggaaacaggctaaatgttcatcaactaagaaatggataaacacgagatgatatagcatacaatgggatatgttcaggtataaaatgaaatgatgtcttacatgctgtagtgtggatgaaccttgagaatgttgtactaagtgagtgaagtcagatacaaaggactacatattgtatgattcgatttatatgaaatgttcagcataagcaaacctatagtagcttaaagtagattaatgattgctaagggctgaggggagagagtatgggaagcgatccttttatggatatggattttctttttgaggtgatgaaaatgttctggaattatctggaatgttctagaattgtacaactatcaccactttcatacacagttgtacagttttgtgaatatgttaaataacacagaattgtatattttattttattttatttttttggagacagactcttgctctgtcactcaggctggagtgcagtggcatgatctgggctcgctgcaacctctacctcccaggttcaagcgattctcctgcctcagcctcctgagtatctgggattacaggatctgccaccacgcccagctaatttttgtagttttagtagagaaagggtttcatcacattggtcagactggtctcaaactcctgacgtcaggtgatctgcccacctcggcctcccacactgctgcgattacaggtgtgagccaccatgcttggcccgaattgtatattttaaagtgtgaactttgtggaatatgaattattatttcaaaaaatatgttgaaaacaaagcaatgtcatcaaattctttctattacctgtgtttgttgaaggtgtttgctgtattcaaggcctgttttccctcaggaaataaaacagaggttggaaagtattaaagaggtgttgttaaacacggcctagcaccagctgagactgtccttcaagcagccagaaaaactgaatgagcttggaaaaaaaactacttcctaaaaccttctaaactcagcttttcaaaggccaccaatgtgaaatgcttaggatttcattcaatttaagcactattaccgtgcccaatttttgttagctgtgtttatgaggaaagaattaggatattttagctggggaagatagcactctctggaaacatactgtgcgatatgacggccactagtcacgtgtctctatttaaatttaattaaaattcagtagccctcaaaactgtgccattgacattttcagtgcctaggagctacatgtggtttgtgttggttgtactagacagtatgatataggacattcattttattgctaaaagttctgctggacagctctatgctaaaagattaaattaattgtattgctatcttgtggtctctttgctctgctttccctcatttaagcaaattcgaatgctgaaacatgacaaataatgattataataataaaaattaatagttaacgtttgtacttgccctgtaccagacagtgtgctaagcatttaacgcatgaggtcttagttaatcctcccaaaactctaacaggtagctaccgctatcacccaagctttgaatgtgagaaaactgagcatcagagatgtcaattgctgaagtcccagggcattgggaggcctggatttgaatccccatcagttggctttgtgctcctcgtccttctaacctctactttttccacaaatcccatcccaggcctcagccagcaactcagagtccctctgtcaaggtctctgagaaattttacttgtcacgttttatcatgaccgtattttctcaggacagtttcaagaaataagtcagaaagcagagtaaagtttgtggctctgcctactgccccctttctcctgtcctacctcccacccagagacaatacctgctaacgatttggagtgtgagtccgaaaccctcccatacttttcctatgtaattacatgcataggtatgtgtacaaggacaccatgcacgtgtgttaagcaagtgggatctcatcacccacatgattttgctcattgcttttatttatctaacagcatgttttggccatctccccatgtcagtctgtacaggtccactctatcattctatattgtgacggcacacaattctataaacagtaataccatgatttatttgcccttcagcaaatggctttgccaattcttacacacaaaaaagggtatgatggaccagtttcttgcatctgtgctcaaactggacatcatcaatcttttaagtttttgccaatctgttgggtgataatttcttttcctttcaaccttcagggtcatttgcagctccctccacctgctctgcccaggcttctagctgctgacagccaaaggcaatctgccggaggcaaaatgaggtcaaggccaaaaaccatattttctttcagtgagagagggcatttacttgggtaaatacggcccatgcactgtgctttattggtttgaaaaatgaagaagcaagctccaacgagttctctctaatggggctgcatgtctccaatacctggtgctccaatgcattgattgacgcattgtcatcacttataaggtcagtatgttcatccaatcctttattcatcacgtaactatcaggcattgattccatgctaggcagagttctaggcactgagaatacagcactgaatagtgagtcaagacccctgttttacgggacttagattctaatgggcaggatggaggcccacacaggcatcatcgttatagatctaagcaacaaaagactgaaatgagaggtatgccccaagacacagagggcccatcacagagaggacagtcaggtaaggcctctctgagcatgcacactaaagaaaagaactgaaagcaagaaggagcatcccactgagaagaaagtgactggagagtgttcaaaagaagccaggatggccagggccttgtgatggaggaggagcctggcaggaaatgatgtcgggtggtaggtggggggccgattgaggcagggccctgcacagcatgataatgagtttggatttttatagaggtgcagtaagaagccactggaaagttttaagcagggcagcagcagaatttggtttattcggtaagctttacgttaagggcatttgaagttctgaagtgcatgaatactttgctttttaaataagacaaatacgttaaagaagtgttaacagttttcttaaaacagggacactctcacatggcttctgcagtgccttttccagtgatggaaggaagggtttggagccaggtttagtggacttactattatgcgtagtctttcgtcttcagtatctgggtcacagcttataaccaaagcatggcaagaacctccagcaaggttgatgcaggggaaagaagattgagatcaagtcttgttgcctctagtttctgttctttgtgtgaatgctgagggcccctctgtgcttggccatttcacaccagcagaaagcttttgggctcaggaatccagggatctatctgccttggaacattctgcatcaaggtaaaccagtttggtccagtagtgtcatgaccagagatgggagaagaaactgtgtgctcgaggtgctggggctagcatgtaggaacacaaggattttgaattctgcaagcatacacgcagttttgaaatcatcctgataagagtcggcaggagaaatggaaaaaaaaaaaaaaatctcttggatggaggatatcagtcctgtgggtaagaaggttcttggttatcatcattatactcccatttttcactacaaaaacatttttagagaaactgatgatgaaaacaaaagattccaatgaatcagaagcattgattaagcttaacagagagcagagtggtggtgaggtgcatgaattgcagtggaaccatccaggttttttccactttctttggcctcacctttttgccctacaactgtcctgcttactgctgtttgaagaaatgaaatccaaccacctccacctcttttcatacttacccatcttgttttgctgcatacattttgagccctatatgtgcatttcacccatcttcctggactctgaactgagccttgtttctgagccattttcagtctcttgcgcaggacttttattcagtctcggttgcaatgtcagttttcttgccctgcccatgctcagaggagaccaggctagtggaggtgcttcctgtgaccaagtggtgctttaactctttattttaaataattttggagcattcagcattgctccttctccccttccttactttgttactctcctctaaggcttcttttccattcatggaagatatttcttcagtctagttttggttcctctttaatttttttcctctctgagggaaggagttgctgttttttactttttactgtctctgtcttaatagggagggttactttcatctgcctgagaatcacgttatcttccatgtgggctaatgactagtgcagcctgagacctgagctcgaaccagccttgtagaagcagaacagtgaataggctgatcttcgataggtaatttacaagacttccacttcttactgattaactttcataactcactccagaaaataaattgtgtatctgttatcatcctattggatatgcagaagctgtcctgagagggttgataaacctttgaaagaatacataaccaagtcagcctctgctgcaaataaaccgtgacagagaaagagggtggccgtgccaccgaaagggacaggtgacagtggcatcagagcaaataatttgcaaattgtttaataaataatgataaatctctaagcagctcctgcattttattcaaggaaaattaagacttaagtatttttgtgttttttgttttttgttttttgtttttttttgaggtggagttttgttctgtcgcccaggctggagtgcagcggcgcgatctcagctcactgcaacctccacctcccgggttcaagcaattctcttgcctcagcctccctagcagctggaattacaggagtctgccatcatgctagctaatttttgtattttttgtagagacagggtttcaccatgttggccaagctggtctcaaactcctggcctcaggtgatccacccacctcggcctcccaaagtgctgggattacaagcgtgaaccactgcgcccagtctcttaagtactttttatatgaataaagtagtcacaggtggtaggtggtacagcaatgtttgtatgacaaagcccagaaagtagcagagagaaggaaggttatatgtgctcacgatgacttatctacataatacgagagaagtaactttctaaggacaagacatgagacagtaagaccattctgcccttgactctctaagacttggaatttcggatccataaagtaaaacatttctccttttaatagacaattagattaatgatgtttttggaatgaaaaaatctaagattagttgagttctttgctgcctccaccttccttcaaccttgactcacttggtaattgtcagctacagcatagccatctaaggaggtacagaaaactgtgggtgagttaaacatgttggctttgggtccaattcctagccatccgtgcaaatgctgtgtgacctttggcatgtctcagaacctctcttatctgagccttggtttctaatccttacctctcagagggacgattatgagaaggaaatgaactatcataggatatgtaaaatagtatatagctgtatgtagcatgtagctacatagcatatgtaaaatgtttatcacatagtaagcacctgttatatgccatctaattgtgtgtatatctgtgtatatgtgtgcctctgtgtgtttgtgtgcacatgtgaatgtgtgatactagggaaaataatttaccttcattaaataactaaatgctttttactactccctgtggagcttgatatataaggttgctcaggaagggagcagtaatttggtgggaaatagtcacttgtgtgtgaatcatctgaagtacccatccttgtgtccggatttggggctcttgagttaaaccactgtttgcttcccctgtccacaatggcttgctgtctacagcacgtctctccatcagcaatgtcaaggatgttttgttgaatctcaaatttaaccactctggacctggcatggtggcttacccctgtaatcccagcactttgggaggctgaggtgggtggatcacaagttcaggagatcgagaccatcctggctaacatggtgaaaccccgtctctactgaaaatatgaaaaattagctgggcatggaggcatgcacctgtagtcccagctgctggggaggctgaggcaggggaatggtgtgaacccaggaggcggagcttgcagtgagccgagatcgcgccactgcactccagcctgggtgacagagcgagactctgtctcaaaaaaaaacaaaaaacaaacaaacaaaaaaaccactctggaaaatcactttttttaattacactatatagtctttctatagttgaaacaacttaaatattccctccccctatgatgaaaatgggattcaaccaaaagacagatggatggaactttatctcatgtatatactatttaatacgctacatgcattctgcatgtcacatgctatatatagcatggtattatgttgtaattacatttaataaacctagaaatgccccattttttcccaatagcctagaattcttagaatagactcaaaatgtgtcacatgttagccaaactgtggtcaactgaaaacagtgactctgagaagatcagaaatggtggctctgctgcttcatatgtggctgaaataaatgaagtggtctacagtgtgcctgtatgtatgatgtgggtgtgcacgtgtgtgaatattagcgagaatgggagaagcctttactaattcttgaaaaactcacataacccatcctagctacaaccttcctggtatcagaaaacccaggaaggtaacgggtggcctgaggaccaagcctgtgcctagggaagtgaggtgtttgaaaggacgtttcctgtaggccacaacaaaggcaaaggaattatccctccctatgatacaaagttcctctcccttgcttggaatgcctgtgtccctgggatctgttgtaaatcttctctggataatgctgtcaacacacagccaatgtcccacacactgggatctcttttttcctatctgtgttggccaagtcttcttttcactttgcctttcttcacacagtgccattaattaggcttgtacattccagccctgcctcccagagatttcccaggtcaccttgacatcttcgagtatctatttagagtccctgaatgtatccttatccttggagagtctcatccactgcgtatgagtttttcttctttcattccaaaggcaacctgagtcctcagcctctgtgtgccatgatgagaaagaatgaatgggaatcaacccaaccaggaagctggctttgtggcgtggtagatgtttgtaaactctgcctgctgggggtttcttggccattgttgaagaccacaagcccagggacagaaagtggacaccttcctccacctgccagccctctttccaagcttctgctcctaacctgggtatgaacctgctcagtgaagccagtttcgttttatgcaggttctgggctctgaaggcctgtttgtgtcattgcacactttgtagccattccgtctcgctgggcctgcctgtaatagcagtgcagcttctaggtggcacttagaggatgcctaaattgacttagaaagctttgcattaagcagatgtttgctcttggggaagattaaaaccattttgcatcaaagaacgaggctgcggcacttccctaaagcttgaaagaacggtttccttttacttggctgagggttacctggtcccctgcttgacaccctcctagtccgtgaaatggagtaaatccaggttagaccaggtgagtccgaaggtggcaggtggctaaggaggatatttcctttgtagctgttcccggccttgtttctacttatagggataactaaagcaaccaaacacacaccaaacaggtgggagacagcagggaaggatgcttggatatggctgagccacgttcctgcctggtagtatgagaattcgaagatgcttgaggcatgctggtgaaagtaggcaaaagcagagagactcgaggctgcatcaaggggcaaaccgtgtgtatgtttgtgtgtatgccagtgtgtgtatgtgtgttagtgtgtgtatgattatgtatatatgttttgtgtgtctgtgtgttagtgcgtgtgttttgtgtatatgttagtatgtgtatttttttgtgttagtttgcatatgtgtgttagtgtgtatgtgtgtgcatgttttgtgtgtatgtttgtgtgtatgccagtgtgtgtatgtgtgttagtgtgtgtatgattatgtatatatgttttgtgtgtacatgtgttagtgtgtgtgttttgtgtatatgttagtacgtgttttttggtgttagtttgcatatgtgtgttagtgtgtgtatgtgtgtggatgttttgtgtgtgtgttagtgtatgtgtgttagtgtatgttttgtatgcttgctagtgtgtgtgtgtgtttgtgtatgattgtgtttgttttttatgtgtttgtgtgttttgtgtgtgttagtatattttttgttagtatgtgtgttttgtgtgtatgttagtatgtgtatgtttttcgtgtgtttgcgtgtgtgtgtgtatgttttgtgtgtatgttagtgtatgtgtgtttgtgtgtatgctagtgtgtgtgtatgtgttaatgtgtgtgtgattgtgtgtatatgttttgtgtgtatgcgttagtgtgtgttctgcgtgtacgtagtatatatatgtttttgtgtgtgtttgtgtgttttgtgtatatgttagtatgtgcatgttttttgtgtgtttacatgtgtgtcagtgtgtagatgttagtgtgtggatgttttgtttgcatgttagtgtgtgtattagtgtgtggatgttcttgtgtatatgttttgcgtgtagtatgtgttttgtgcgtatcttagtatgtgtatgttttttatgttagtttgcatatgtgtgttagtgtgtgtatatttgtgtatgcatgctagtgtgtgcatgttcttgtatatatgttttgggtgtatgttagtgtatgtttctgtgcgtatatgtgtgtgtgtgcatttcaagtgttcactgccagagaagtggcttatcagtgggtcagaagacagcatgtacgttttataatgtaccagttaagagtccagatgtgagagtcagatattgctggagtcatttcctaactcagctctgcactagtgtgtgaccttggacaagtcacttagcctctctgagcttttgtttcctaatttttgaaaaataggatgagacccacatggaatgtctcctgaggcttaagcaggatggcctgtaaatcacccagtgtggggcctggatcattgagagcaatgggatgcgctgatggtggtggatactgctgctcttacgctgtgactgctggggctgttgttgctattttcattatgagaggctttgggagagacagaactgcacaacggattgccgtcagcctccatcctgagttcctggggtctgggttctttgtctgttgtgttactgggcggggggaaaacctccagataaacctgtcaagctgttgagaaatcctgtctcccatctaactacttgtgtgttacttacaacgtgtgagacttaatgacttcttctgtccaagggggtaaaacaaagccaattgcattaccttgccatgagcagccaatgaaatggctagcacagagccgttagaacagtgtctgagccagattcaatccttcctccgaggtcacccctggagctaataaaggaaaaaaaaaataagtaaaggccgggatcttgtgggcctctcagcctggcaaagtgcctggcataaaatgggtcgcctggcttttaaggcagtgtgccgagcagctggggaaaggtcatcatgagttcacagaacctttaaacacactgggacttaaagccatcagatcccttttgctggctccatttaagttgttttgttggaggacaaaacctttttgcttacggctaagtacattttatggagcatttaatgattcttctatagacgtttgagtagctgtgttttggtttcaggggccgaaaataagtgcccagaatctcccgtcagtcttcttgatgtttattatctgggtggagggggagggacggggctgcttagcacatgttggcttctgggcttcattgttggcacttcagcagaagtgggaagaggcatatggccttcctggtgtcttatggtgaggaaaagaggacatttgaggggaaatatttttgaacaggaagacagcaagatcgtatttgtaggtgcgatggaaaagtagaacagccagtcagctttgggactcccaagtcctattaaagctcacatcttttcaaagcattttaaagattaggaatccatctctccctgtctgttggtaatcgtggggtgcaggagtctacaacagctcagcttacgtctgacgagctcttgtctgttacatcagtaccttgggatgtgccgggctagcggctttcccatcttctaagcacttggctgccaggaaagacggaaccctttgaagtatgagatctgtttatcttgcagttactatggagaaagggccctggaattaattgtaggttattgaatttgtcctttttaagaggaaaaaaaatgactacattatggtgctaattcatagatcttgagatgctagcatttttttgtgcgtgtttaacatttcatttgaccattattagcagtatcaggttgggttgctgagtttcaagtactagaaatctacttggactatctttggcaagggagagcatttattgggaggatattgagtagctcacatgatatcaagaagaccaaaaaaaaaaaaaacaaaaaaaaaaaacttggatcccagaagagaattattcagccattagaggctggctgtagaatgaatgccttttcttctatctgaatgatcctctagtcactttttctatcatcagatctctctggttaaaatttgaagtcccagggcagggaatacttgctagttgtgttctctctctaaggtaatctgttggaagaagtcagaagaaatctttagagctcccattgtgagggcaacatacttgtttttctgcttactaacaaggaagagacaatttctgtaaaaggatatcaagatgctgttaggaaggtgtaatggatactagtgaatgtgtcaattagatgccaagcactctgactgttgatacattcttgagacctacaatgatcagatgattcttttggggaatctatctgtctgtctgtctatccatccgtccgtccgtctgtccgtcgtctatcaatcatctatctatcattcgtctatctatctatctatccatccatctatccatcccaatacaaaccatatacaacctcatgatggatagggtttcaagactactgtcacgatcatgggagactttttctttcctctttttaaccataaacatctttgtgagatataaatgtcattagaaaccagagaaacagatgatacactcaatggggtaataaatatgtaaaggaccttgccacttattttgtagcagggaagaatgtagagtatatctgagactgagaacctaaatcaggacttacctttttttatagtctcagtccatccaccaaaccatagccatagccaggcaggacaaaagaaccttgttagttattaatgttgaattgctgtattaaaattctttcagtgagtgattctcaagaaggagtgatttttttcccccccacagggaacattcggaaatgtgttaagacatttttggttgtctcaattgtgtagagtgatgctgctgacatctacgggatagaggccacggatgttgctaaacatttgccaaggcacagaatcttgtgctgatttacagcatcatctttgcaaacattaagatggcagggcacagtaaaggtactttacttcccacagtacagaattatagcacccaaaatatcaagagtgcagagatagagaaaccctgttttagtaagagatgtaaacacaactcaagtcagtgtatgcaaagtgatgactcaacagggaagatacaggtatctcttacgtgactacatccagggtagctgggacccagggaaaatattaataccctaagactctccttctttgtctcctttctttgtgtcagtttcacttccacaaactagcttcctgcacatggtgggaagtatggctgctaatagaaggtgggtgagaagactcatcctgtgatatcagaacagaaagactctgtgtcagaaactcccagggaaggttttgattggcctggcggaggtccagggctcatcactgagccaatcagctatggcctaggtgtagagctgggtcatgtggcacagacatggcagctgaccctctaaacagtgtattgaggcctttcccagcaagaccaggatgattttaagccaggctgccaccccattggtgtctgctgccattgcatgttctcttattgccaggacatttgtaaatccgatgttgtttccagcagagctgtgtcagagaatgtcacttagccattgccagatcgttgagcaccctggctgaaaatcacaaaggcacggcacctagagaggaaacgaaggctgtgcatgtttccagggaagctgcgccctgacatttatggctgagccgagtttggccttgaaaaaaatcatccggtccagccttctgcctccaggcttgtgaattgataaaccctccaggacagacaggctgttgaggcacagcctgagatgatttctgtccttcctccctggtccaaccatggaggctgccttagtcggcttgtgtcctagttgatatatttgttggaatgtatttgaaactctggtcagtttctctgatgatattgatagttttcttttttttttttcccacttagatgaaatttgtcaagcctgcattgtgctaagccctattaaaatggtgccagagacccaattatggcagctacaaagccgttcaagagtaagcagagaaaaacacataaagggattaaagatcaaaaatgggattccagtgaaagtacattaggagacatcaggcagagacacatgaaagaattagaatatgaagaagaaagcgcatagagcttttgggatgtccttacttttcatccccccaaatcatttaattttgagcatgtttactcttttaaaaatgaattgaaatgatcgattgtacttttgtcaggtggacatgtttttaactctggtgtgaaatgaattgcagatgggttttctggcttgattccctcccccaaaccccccagttttttttttctttttgtcttagacaatatggtgtcagtgaatcatgaaatactgccggtgagcccatttagtgagttgggaaagatggtctcctgggctaggtggtgttggcaatgacactctggggaatggctgaggcccccacccccatcttactgtttgcaaagacgagactgtaaatcagcacaaagtgtgcatttgagagttgctgttttgagataaagagtgcagttcagtttgtagtcatcatcatgttggttctgaagaagtcctgtcacaagcagagctgcacagaatcaggtgtaaatctgtcattttggctagtcttcctctggtccctctctcttcgatggattccatgacaagtccttaggcacatgtttgatttgcactctgttgtttgctatagaaatgtgtacgtggcctctcaggaaagagaagtgaccctctgcctatatcatcgtgaaacatctcttccaggtttgcattctggagttaatggaagagatggaaatctaatcagctcacaatagtctctaactccagactctgatgctcacaacattctgtatatgtgcatcagtcagttcaatgggaatagtggagaaacagagaacaaatgtcccatcccatctgttctatctaaaggaggcagcttctccttagctgcagtcatttttttcaatgcaatagtgcaggctctgcgttgtcagattttctgatatttcaaaagaaggtaaaaatccagatttttgtggggatattcattatgatgatatatatatatgcatatatatgtgcatgagcacgtgcacacatgcgtgcatacacacacacacacacacacacacacacagacactacacatgatcaaacacatcattagcccaagggtcaccagtttataatctttactctaaagagagagccaggcatggtgtcttatgcctgtaatcccagcattttgggaagccgaggatggtgaatcagctgaggtcaggggtttgagaccagcctggccaacgtaatgaaaccccatctttactaaaaatactaaaattaggtggacatggtggcacacaccagtagtcccagctacttgggaggctgaggcaggaggatcgcttgaacccgggaggtggaggttgcaataagccaagatcctgccactgcactccatcctgggccacagagtgagactgtctcgaaaaaaaaaaaaaagagagagaagaaaggccgtaagtatttttcaaattagtgtttgatagtctatccattttggggtttctttccctgtttatcttcaaaagtgccatattttgaaagtttacgtattaccagaaaaccagcatcattcatggagtctttatatgcttaaaaagttttcttggaggtctcgaaacacccttagtcttaattcactttaaaaaaaaattggagccgggaacagtggctcacacctgtaatcccagcactttgggaggccgaggtgggcagatcatgaggtcaggagatcaagaccatcctggctaacacggtgaaaccccctgtctactaaaaatacaaaaaaaattagccaggcgtggtggcgggcacctgtagtcccagctactcaggaggctgaggcaggagcatggcgtgaacctgggagacagagcttgcagtgagctgagatcacgcccctgcactccagcctgggtgacagagcgagactctgtctcaaaaaaaaaaaaaaaaataaaaataattggagtgtatgtccttctacagtttagggaattaatggtgagaaaagcaagccagacagttatcttcagattaagtaacaaagaaagtgccctctaatggcctgggaggtttcattcattttttgtggaatgagaagggaggtgaatctttcttttttttaacacaatgatcctgcagctgagcaagaagtgctagatgatcctcctggctcgaacaggatgatggtgaagagatagcatggtggtggtagaagtcgtaatgaaggtgaaagaggaatacagaaaagaaggaagaaggaggtttttcacaactcagcgtggattggggtatcccactccggtgggacccacagtctgcttaatataggagattgactccaagtcttgccaccttcccccagcccaatagtaaaaagcaaacacacccaaacaaacagaaaccacgatgttcctgcagctctcgggggctgaccatgtcttccagaggaagctcaaagcctgttgttgcatgcttcatccagcttttctgcaaagtggaggccctagcaagaagcaaaggcagacagatggtgtcccgcagactctccctcaagccctttcatctctcctctcactattaattcatctgtttggatggatatgttcacgcatggaaccaagatgaataataatgaggtttttaataactccctgcatttgcattcctagttactctttacatggttctagctgattaaaatgaatcatttacataattaacatatggttatagtgttggctttaatatgctgattatctcaatacttttgtctggagtcaattggattctaactgtaacaattgtttgaagtgagactagtttattcctgggaggatggaggggctatttgccatggtgtctgattagcaatagcatacctttccaacaagtttgttgtgcttctgttttgtaatgtgattgaaaaataagtaaataataataataattgcagtgatcataatagctcccattaattctgggacaagtactatcaatttcattatctcactttcttgcagccagcctgcaaaacagcaaggcttatccccactttacagaggaagaaattgaagcttggaaatgttaacgggcttgcttgaagccaccatgctattatgtgtcagagccttgagctaggctttctgatcccagaattcatactttttaattactctaagtcagcttctgaaccttgagactattgacattttcaagcttggcactatgactatggccagaaaattctgttgttgaagggtttccctgtgtactgtaggacaattggcagcaactctggactcctccctgtggataccagtagcaccccttccctcattatgacaaccaaacattgccattgtcccctggggaggggaatggggtaaagtggccattgattgagaactactgctctaagttattttcttggtacccattaagacaaaatactaagaagcagacatgttatctaggttggtctttcagtgatgggtaactagggcctaactgcagtaatggtatttggaggtacattgtgatgtgtgtgactcctgtaactgattctgaattttccaattatatctgccaggaatcactgtatttgtcaatcaaagcgatctttgttttttatcaacgcgggtaagttctgtctccctcactttcccttcttcccccacgctccctccccactctttttaactcctctaaagggcatgcttgatattttcagatgtgctgccttgcagagttgatagcatgcatttcaggataccattctctcattagcacatcctaggcatgggtgccatccgctatgatctgattatcttgctagttcatattgaatttgaaagggacttgtgaactagtggccagttttcctgtttaggtacccgaggttttggaatgtgagtgctttctgaacattcatgcatatttgaaacgcatttttgctaattgcaggactgttgtccacaattagtctttggtaggcatgattaattgcaaagaacactgacatttatgcataaaatgcttgaggtcaaaaagaaatggagagaaatggtgactgcagccagggtgagtggaatactgatgcatggtgaccccagaagcaaagccccaatcaggaaattgtagcatcagcaggacaggtattttattgggatggatgtgtctgtatttttgacttgcctgtattttgttctcctctcctctaagcacctttagttttacgcaggttttcagaagcctgtctgatgttttcataaatgccaaggcctgccttttactctccttctgcccttctccctcccaaactggccccatcacttgaagctcataatttacttctttaacataacatttgtgtgttgtatgtgtcccaggaagaatcaagaagtaaacaaatgtgccacagtcctaccactgagattaaccagtaaacttttttttctgcttaaagtggtacgtgcctgtgattaataattcaaatgatgctagtaacggaagacgggaaatgaagcccatctccaaatcttggatcttactaaagctaatcagtatcagcggccattaggagaaagaaaaaagcaccattgtgtatagatatgcacatatatggccaggtgcggtggctcacgcctgtaatcccagaactctgggaggatgaggcaggcggataacctgaggtcaggagatcgagaccagcctggccaacatggtgaaaccctgtctctactaaaaatacaaaaattagctgggtgtggtggcaggcgcctataatcccagctactcaggatactgaggcaggagaatcgcttgaacccatggggcggaggttgcagtgagctgagatcacgccactgcactccagcctgggcgacaagagcaaaactctatctgcaaaaaagaaaaaaagatatgtagatatatgatacatacatgtgcatacagatatatgttgttttcacatactgacaaaaaaagccacatcagtctaaatgccctgtgtgactttatcttgcttaatttcacttgatgatatgccatggagcctccttcagtttttctacactaggtggctgtgacataccttatttaagtcattcccttaattcctttttttttccattataaacattactgctacacatgcatacactgagttatctgatagagatatttaaataaaacatatatatgggccctgattactttttactgccatgttaatttcctagcagtgtgattgttgggtccaaaagttggtgtctcataacttccatttaaagatgtgattcaaaacttacctcctactatatataatgctattcaattcacatcactttctcaccatcagtgcagacatcctatttgggcctcggagctggagttcacgtaaggatgagtaaccacttcatacttcagatcccatgagagcgggatcatgtcggtactagcaggctctaaaggacacagtgttcaccctgcttaggatcagacaactgcctagtctgtgccaggcatctgatacttgccttggtaataggattttgcttgaagttctccttatgcctctttatttcttttatttatttgtgctgacaagttagagtgtaagctcattgaagcctgtggccatgtacagaaagagaggtcacatcttctgccaaccctgattgattagtagtggctgttaggagctctgtctggagaaggattgcatctgacttaggaagaaggagtttcagaatcaattagtaatgtctgctaagtgcacagaatggtggaggggcagcctgtgtccccagtattctttttccattcttccataataaattaggattattattatggttattgagggcttacagaaaatttttgaatcaatataaaaagcagcaatgggaaaaggagaagagagggagaaagggagggaggaagagaaggaggaaaagagaagagcaggagacagagagagagaagttatactcaaatatacgaagaatatcttgcttctaggtggctttatatttgagcttttctatagttttgaaatttataggaatttaaaaacatagaaattgcatttttttttttttgagatggagtcttgctctgttgcccaggctggagtgcagtggtgcattcttggctcactgcaagctccgtctcccaggctgtagccattctcttgcctcagcctcccgagtagctgggactacaggtgcctgccaccatgcgtggctaatttttttgtattttttagtgagacggtgtttcaccgtgttagccaggatggttatcgctctcctgaccttgtgatctacctgccttggcctcccaaagtgctgggattacaggtgtgagccaccgcgtctggctgaaattgcattacttttaattctaaaacaacaattagttttgcaccaacctaaggaacatacgttacatttgaatttagaacataaagatcacaatacatgttatagtaaagacagtcttttgaagcaaagctacaggtactattaagaggcacagtgatcctgagatgggaaatggagggcagttctctgtcgttctgcagtttcttggttttgtgagaccactaagtgatgtccgttctctcctggcagaatagatggtgttaatctccagtcccttgtaataaatgctggactgtgaacaggagatggctaaaagagagtgcccgggcaagcctttatctttaataaggtccacagccagtctataattgtcagaaatgacagaggaaacagggcttctgctattttgctcagaataagaagtggtgtctgacctgtgttggcagcaataattgcaatggtcagttattgaagttgatcattgcaatagttgatacaggggcccagctctttgcgctgatattgaggaagccaccaggccccacactttggggtctggaaacattcacagagcaacttttttcaagaagatggacacattcacgttttaaagatgctcagcttctcgtgagagagagtttaggtacattctcattccactcaaatcttagcttataacttaggctcctcgtagcagccctttgcaatgaaactgtatcacttttgaagcttagcagatgggaattgtcataaatgatattttagtcacagatatgagccataaaacttgaaagataaagtatctttctgagacacacatggagaggcagatagacccagatacagcgtgagcttttctgcagctctgatggtgtggaacgaagggccaccaataggtactttattgcaggtgacagggtttgcagatgatgtggaatagtgggaatggcatggagcatgaattttggggattcaatatggggtcaaatatttaccatcccgtggaatcacatttcttatctttttctgaggctccgtgttttcgctgtgtaaggggaatagcggaatgtccttcttaaggtgtttggcacaatacagataaacactaaataaatattcctgtctgtcctccctacagcattcccctcaaatgaatgtgttgcttattgctagttatgctggattattctgctcagttgaataattcattagggcttgagttccaagatatggtgtaactgtatccagcagactctagccttaagccaatatgtatattaatgctttttactcaaggaatctacctggctcttagcaatcctaaccccacccccacatttttaacctgacaggaagattaatctgcatgagatgaagggtgattgtcatgtccaaactaaaaacaaaaaaattaaaaataaaaaatgacagaaatcttctagaaatacctaaacattccctcttttgtcttcaacacgtactcggtccccttcttgtgctcccaggagtcttttaatgcctttgttttcacagcatcaagatatcctggcaacctagagttaccgccatgaggtttggccaccttatctcaaacaactgcgtattttgaaataggtggtgatagcatgcttttcattccatccagaaagtgtctcttccatgacctgccagcactagtatttcaagacctctgcacttacaaatttaaacggagcctggagtaatttaaattaatgtgtacaacatctgtcttggtgagaggagatgtagagatattctccgtttatgcccatctggctttgttagagtagataggcgtatgtttcaggaggagaaagaacattttttatttctgctatgtttcagacattatgctagccattacgcattatcctgcttaatcttttcagtaacgttggtagattaatatcattatccctaccctatgataaagattctgaagatcagagaagtacatcgtttcagtgaccaagtcactgttaaatgacacagtctgtattcaaagacaggacagcctgattccaaaactacttctatgccatcttattagtctcaaggtaatacaagtctaatgtgtttttgcttctgataattatagcagtaactacttagggtaaattaaaatggaatatccaggaaccccattatggtggtaagagtataaagacaaattagcggctatggaatctcaatccaggaaagagagacctgcattgggctcccatgtgttacgagaggttttgtttttttgttttttttttttttaatcatcagatgttttgggtgttcccagctgtgcttgagtgcatttgagaaatgggtttatactcttctcgatcccctagttcttcccaaaaggtagataaggggactcacataaacagtaactgaaagtcattctgtgtgacaattctgtattccttgttgttttagtaaagtttgtcctgagagcaccttgcctataaataaatacagtgacaaataaaatgaatgatttttctgggttcctttcctactctctctccccccatgctttaatgaataattttaatctactttgtaattaagacactagcaataattttattatttggtactacttgggaaaagtaatctttgatatgagatactttgcaaagggaagaccttgtgcccacgtcctgccttaaatgcgaagtaaaggggaaacctggattcaagaactagagccattggtaggccaaacccctatcccacaagccagggaatgggatcttttaccagacactcagacatgaggtttggttttattttttattgttctgaaaagtacattgtaaaaaagggagtgtacatttctaaggcacttttctaaaacaacaagaaataatacaaatatttagtaagcaagggatgattgcatttttggaacatatatgtttatgagctatgtcaatatatatgttgatgtgataccatgaaagctgttttagatgaaattctgataaacagggcattatattgccacttacttgctcttaattcgattctattagcagctcagctttattaaaatttctcaaatgtattccatgtgaaatcattttatttcatatcgctaatgtatgactcaacgcagcatcgcctttgaggtgatccaggactttcatccccatttcacagatgagcactggagataagaacaggttaagtgatttttgcctgaggtcaaacatgctgggagaaagattagaagttggtgagtgtttaccacagctctgtgtctgtgataagtccctaaattcagattttccaacctccgagttttctgggttagacctccagctaactaccaggggatgtcatgttatgtaattaattacaactgtaattatcttggtttctgggtcatttgaagatcatcggtgctttttgttttcatggttcatgcagcagaggaattttttttccaaagtacaagtataattaatccaggttttagactcttaaataaccggaaagttaaaacgtcagtgcagaaactgagttcatcttggctgatgtcccttgcagtagagatggggagaattcagagctgttaaaagtcgtggtcatctctcttgaaacataaaacttccctaccagtgtctggatttcctaggaggtacccagtgcatagacccatgttgtatgaatgactggcctcatacaagaggtaaacatagtatccttgtatgtccctaagtgtcaggtggttgcttggaaaagcagtgatttccataggtccctgtaaagatttcttcaaaactgatggaaggtataaatgtttaaaattagctttcagtttccacttctttttcatgatatcttacatgaaggtaatctattgaggaaattaccttttatatcagtttaaatgaacttatttagataaaataccagtttaaggcattcttgactttgttctattccattcatggagatttgcttgacaggaagtgctctggcatatgtcagtgacctccaatgctcctggagcagatgatactgggacacaggtggtccgtatcacccacgtgaggtggtggcatgtatttatgtgctgaaccaatcggaagacatctcattcagaagaaccaggcctgtttaccttattcgtatgtcattataggtgacacacaggaagagtttctgaagaatcatttcatcattaagatatattcaatatgacagcttggctaacacatcaatcatttggaaaaaaaatactgtagtaacagcctaaggagaatttaaacccttgtgctctggaatctgtatttgcagggcaggaaaaaatgttttagatttgtctatggcattattctttatcagtataactttatagcgcttgaatgtctgaaagatgactcattcatttatttgtgtattcattaattcattccacatatatttgtagagaacctatctgggatctaagaacaatttcaggcaccagagacacaggggtaaacaagacgtctaggcccctgctgtctcagaacttaaatttagtgggacagataggtggtaaacaaataagaaggaattgagagtaacaagcacagtgaagtgaaatatgccaggtgatgaaatagcaaataggagattgatgctcccatagtttggagactcagagaagttttaaggaggtgatgttttagctgggacaggaaagaagacagccagggaggtatggagaggaagagcacggggaacagaatgtgcaaagtctctaaagttagaataagcttgacatgtctgaagaagagcaaagagactccggtggctagaggattctaatggagaagtaggaggcagaaaagaataattgagaagtagatcagtcagatggaggaggactttgatgggcggcagagtaaggcagtatgagctttatcgttgctgagccggaagttgttatgttatgcaggaagctgcgatgagtgtgtacacaaaccatctcctgatctcgagccttttcctcctgagggcaaggaggatcgggaggcaagggaaacgtagtggtgatgacgaagcttctatctttcagggtctacggtttagggattgagagtatgtgtttgctagcgagacctcacgaaaccaagccccctggagagtccctgacaaggacgaggtgcaacactgttagcggaatccatttcatcgcagaactgctgtcttccaagccttctgagccggctggtacttgtgtaacatttctgtcttgggtgatttccaactggatatgtcatttctaccaagccagtggcaactccagcctagggatgcatttaatctgggacatggtggtgggagaagcattaggcacattgtttttcttccttttttttgaagaatgcttggtacaaattcagttttgacctcccaatgtaggcttttatttcccaggcacttcctttttccctgcatccgccaaaccctggtgagctttctgctgcttttctcaatggctgatctaagtactgcagaacacggacactcttgggcacactgcaaagtcagcctggctccttggccattcctcttgcagggcacaaaaggaccttccaaagaggtggggtagtgtattattaagtggcaataacgaaggacttctttagattatcactgtttcaccagaagacacaacaggagagcacacagaccttgaaggaaatcccaccactgacatttagaatctggtggactgcaagcttagatatctactctctaaatgcagttactttatctatgacctggcaatattaacagtacttatctcatagaaatgtagtactgggtatgtttctggccagtcataaacatttaataatggtagccaatgtcatcacttgttgttaatagtggggatagcagtaaactctctttcctctcaaggttaaggggagtgtttggaagagaaaaaaaagctgagactgaatgacgtttagctttttgatttcaccataaactaaagagtttcattggtaactgtgccctgcctctttctgtccaaaagagtatcttatttttagactgttttaaaataataacagtattatctgatggaggagacaaaaatacttcagtaatagcctaattggagcgaataagaaaatagaacacttgtgtgcaatggaatactagaaagcagtgggaatgaatgaattggagctttatataagaagaatggcttctgccattatgactgtggataatttactaaaaaatttaaaatacactggagttttagtactttctgctgtccagaaatgcatacatatgtggtaaatatatatagacaataaagaaactcaaaattcaggatattgtctgttgtagaggtgaggcagagggctacatctcaggagggttttagacagggtatttagccacactgaaattatttcttaagctgggtagtaactacaggaattccttccttccttcctttctgcctgcctgcttgcctgcctgcctgcctgccttcctgccttccgtcctgcctgcctgcctccctgcctgcctgcctccctccctccctcctcttccttcccttccttcctcttttctcttccttttctttctttctagatagagtcttgcctttatcacccacctgaggtgcaatggcaccatcatatctcaccccacagccttggcctcctgggttcaagcacaatcctcctgcctccttctccaaagttaggactaaaggcacacaccaccaaaccttgcttattttttaaagaaaatttttagagaagagtgtcttgctatgtttcctgggctggtctggaactcttggcctcaagtagtcctctgacctcagcttcccaaaacactgagactacaggtgtgagctgtgcctggccagtatttatgttttgctgtataccttttggtatgtctgaactatatcacatcatgattttagagtcagaaatgctcagagtttagaaaataaccatcttcaccacatagaatcgtataaaataaaaaatgttttttctccttccctttcttcctcccccatcatttaataattgtttagtacatacctttgcagatattttgtgcatattaaaaatatacacatttagaacatatatgcttaatataaatgactttatgtctatgactctgttaccacttaaaaatagtgtacaggcttttcaatgttggcacatataaattatgtacttcagtcttaacatctgtctggtaatcatctttcagtgtactgtaatttaaacaaccagtttccctattgatagacatttgtatttaaaaaacaaaacaaaacaaaaaccagtttccaaactctggtctgctttcaattcagacgctggcagcagctcacaccgctgatcatccaaatgttttgtctttgctaggacgataacccagtcgtttcatacaactgttttcgtttgcacctgaatattccatggctatagccacagctagaaatccattctctaggggaaaataagaaatgtaataataaacttaaaatccctaatgagaaattcagatttcatagaagcaggggtcttctccctcttgctaaccttcttttccaagatgttagtgtttttcaagaatcgcaggctttttaaatgtcctccgtaaagtgtaaaggggaaaatggagagaaagaacagtattttgaatctccagagttctcagtgaaagtagacaggtctatcctagtgttctgtcttgcatgaaacactttcttggtattttgtctacatgagtgtttaatatttaggtcatagtttgtgaatacactggagatgttatgcgtcaaacaaacccagtgttctggcttcacagcagagtaaacagacacagatagttctagatgcttgaacttctcccacgttaaacttaaaacagcctctcatctcagggcttccatcaaagggattgaggccgtgtctctcaaacccaggtgcaagtggaaatttttatgggccctgacttttcttgttgtccttgttggctcataatattgccttattgtgcaagtaatgcatataacttgtgggaaaaggtatagtactataagtaattagaaagaaaaccatatttgaaatttaaaatccttaaacacatacctaattcctactcttcctttctgaaattcctgttttctcaatgatctgttagtaaaatatatagactacaaaaatgggttcatacatcgttcccccccgccttttttttttattttattaacagcttcacagtgttctgttgcatgaatataccctaaaaagaggatttgttttggcattggtgcctgttctttttcagtgttattcattattttgggatgttgcttttattatttttcatattttattttatttggtaggaaaaatgcaaatgtcccaccgtatggatttgggatttgcaagtcaggaacagtgggcacactttcccttaatggttggcgtaggcatttggatactgaatttactgtttatatcacggtttctccaccttggcagtgtggacgctgggctggatcattctctatgtggggactgctgagtgctttgttgggcatttggtggcatctctagcctctcctgactaaatgccaactgtagttctccccacactgtgatgcccaaagatgtctctagacttggctcactgtcccctgggggatgaaatgtttctccctttgagaatcctgcttttacgcgattggattcttaagttgtctgaaggatgatcttttcttgtagcatttataaatcagttggaagttggttctggattactgcctaaaataaaattcaacctattctgagaaaacaatatatttgagtagggactaattacctcttttttatttcaagtgacaaaagccaatatatcacacttagccactatgaagactccatttcagtaaactaattaaactaatcctatctggactcattattctcagttccactaaatattttaacagttgagatttatctcatttcataaattatatcatacttaaagctatccacagccctcaagagtttattttggacttttaaaaaatgtgactttaagctgctctggaatgtatatttttcatatcttttctagataatcattcaccttgattatgactaattattaaacatgatatatggctttaattaaatgaaagtacttggtttcttgttagcgcttattaaatactgacagtgttacaaagatagtgcagcagaggaaatggcataactcaccgaattgattccattttcttgctgtaagccagtgaagatacacattttaagagactgattaatgcgcaagatggcaagaacagtgtttttcatagttaaaaggaattaaaatctgtgtccatcctggattcattttctaacagaggatagtcacctaattaaaacgttaatacacatcccgctatttgtatgtacgttccaaagccagcatacattaaatagaaatttatcccaagtgcttcatggagaagccaagaggaataatgcctaagtaccacttcagagtaaattgctccctacttataatcgtgtaatgcaattaaattgaggagctgtaagctgcctacatcaagtatgtttagtttagatatttgcctttagacatctccctgtaaagggttccacattgaagagaaaagaaggaacatctagccaatgagctgttcattaaacttgacatatggtaagcaaggccagaaaatgcctaaagagtagagaattttctttggtatctaaagaaaaaaaaatgcaatatccagttgatcttagattctgattctagcaggtgttcatggtacagtcttgttctgtgcttcattcaagaatgggaaattcttgtttatcccgttgtccatgatgtgcttatttctcatggcatgcctgtatcaaaacatctcatgtatcccataaacatacacacctactacgtacccataaaaattaaaaaaaaaaaaaacgtaaaatgcaacaacactaggcacgcattttataatataacttctctgcttggacaaaattaggctccccagtggaggcaaaaacaaaaaaagcagatggcaaatatgttagtgacattgttttaagtgtttgaggtcatggagtcttcacattgaaataatctcttgaattatctgagttttaggctagccagggccaaggtgccagctgaattaatgaaacttggaattcatcttttgagttcccagtgaacatcaggaaatactttcctgacatattgacctccttattatccatttcccattctccatgttgaaaaccatttcatatttgagagctgagaatatgacaccttcatgataaatttaaaaataagatgcaatattattccagaattgccttaagttcccattctgtatattaaacgcctattcaaagggtattcagatccaagttacatcatacaaagtatgttaaagtatcccaagtatggcctggcgaggtggctcaagcctgtaatccccgtactttgggaggccgaggcgggcagatcacaaggtcagaagatcgagactatcctggctaacatggtgaaataccatctactaaaaatacaaaaaattagctgggcatggtggcatgtgcctgtagtcccagctacttgggaggctgaggcaggagaatcacttgaacccagtaggtggaggttgcagtgagcagagatcgtgccgttgcaccccagcctgggcaacagagtgagactccatctcaaaaaaaaaaaaaaagtatcccaagtatgagaaacatcagtataaatagtgagaaaacatatatacatatgttcttcttatatttacgggagagatatgtatgcttatctgtgcttttcatatatatatgaaacatatatgaaatatatatgaaacatatatgaaatatatatatgaatatgaaaagcaaggagtatgaaacttatatatgaaatatatatgtatgaatatgaaaagcagggaaaaggggacagtcatttagtgttgctgctgaaaatttcaatatgaaaaacgaggaatatatagctcaggtgcaacaggcacctttatatttataccattacaaaaacatggctctcctggtattttggttcttgaatttaggcttggagctgatattgaagagctgcttattgcagtgggttttcatgccaaacatagctgagtttgaatgacatttctgttactctggctacagaatcttgggcagtatcatttatctatccatctgggctttatttttcccatggggaaataggagggagaggggtcatggagtgaacagctttgcaggccatgccaactttggaattagtggagagaatataaggtaaataagaccatcctgtaatgacaacctagacttagacttgcacgaaatagagatgtaagtcaggatgagtctctcattcactcaacaaatatttattgaatgccaacccttctcagccgctgggtattcagtggtatagagtgtgaacaaaatgctgctggcatagagcttatattctagttgaaaggaggcaaacaataaataactgtgtaaattaatatatggttagtgacaggtgcaagtcagataattaaaacagagagtggtggggagctctagaaaggctcctatgaagaggtaagttgacatttaagctgagctcgcaatggcaaatcatgccaaggcagagagaaagaacattccaggaaaataccctaagaggagaggaccttggaatttttgaaagatgaacagatccctggaaaatagagagaggggcaccagagaggtctgagaattgggcaaaggccaggtcatacaggattttgttaaccacgataatgaatataagttttatatgaattacggatgcagagatttgcatttcacaaagatgactgcttgccacgtgaaacatagaccagtggggcccaggagaagaaggcaggagagcagttaggaagctgtctgggagtccaggcaaggggtcatagtggtttgaactggaaggtggttctgaaatggaaggtgaaggaaatggaagtaccgttgtagaaaattaacaggcagatctgggaaaacccagtggaggtgaagggagtgaattaaaatgattccaggatggagaggtcggggcttgggtgaatggtgccatggaaagtaatggaggtatctcaaatagaaagtagtgagtgggaagagcaggagtgagcttgcagaagttctagcagaaatgtgaaaggccatggttatttgccaagatggaagatagattaggtggtggtcatctcatttgggcgttgaaacttgttttcaaaacctgtacctggttttgatttctacacagggatgcaactggcagatgacatctcaagaggtgggtttgtcatggtggttattattgtacatgtgagacttttagcttttaaggtttttggtttttttcgagatagagtctcgctgtgtcacccaggctggagtgcagtggtgcgacctcggctcactgcaacctccgcctcctgggttcaagcagtttttctgcttcagcctctgagtaggtgggattacaggcacatgccaccatgcccagttacttatttatttatttatttatttatttatttatttatttattttttatttttagtagagacggagtttcaccatgttggccaggctggtctcgaactcctgacctcgtgaaccacacggctcagcctcccaaagtgctgggattgcaggtgtgagccaccatgcccagccagcttttaaggttttgccacacgctaaacaaggcatggtgaggactcttgggtttgagatcccaacagcctcagagatatcagatgtagggcaaagcgggtatctgcatcccccaagttctttccttctcactaaagtgcttgaagtactggtcctttatgatactttcagttctggagtacatgtgcagaatgtgcaggtttgttacatagctatacatgtgccatggtggttgctgcacccatcaccccgtcatctacattagatatttctcctaaagctataccccccagcccccaccccccaacaggccccagtgtgtgatgttcccctccctgtgtccatgtattctcattgttcacctcccacttatgagaacatgtggcgtttgattttctgttcttgtgttagtttgatgagaatgatggtttccaccttcatccatgtccctgcaaaggacatgatctcatgtttttttatggctgcatagtattccatggtgtatatgtgccacattttctttattcagtctttatcattgatgggcatttgggttggttccaagtcttttttattgtgaacagtgccacagtaatcatacgtgtgcatgtatctttatagtagcatgatttataatcctttgggtatatatccagtaatgggattgctgggtctaatggtatttctagttctatatccttgaggaatcgccacactgtcttccacaatggttgaactaatttacactcctaccaacagtgtaaaagtgttcctatttctccacatcctctccagcatctgttgttttctgactttttaatgatctccattctgactgccatgagatgttatctcattgtggttttgatttgcatttctctaatgaccagtgataaagagcatttattcatatgtttgttggctgcataaatgtcttctcttgagaagtgtctgttcatatcctttgcccactttttgatggggttgtttttttcttgtaaatttgtttaatgtatttgtagattctggatattagccctttgtcagatgaatagatggtaaaaattttgtcccattctgtaggttgctgaaacaggcagttttttgagtgcttgccacacaccaaccattgtgcaaagtacctaccatgcattatcttgctaaattagtataggattagtaataaattctatgagctatgttctatttttatcctcattttatagataagaaaactgagacccaggtatttgattaatttcacacagctgataaagagaggatgtggattctctaagtccagaattgaggccgtcagtcactggatcgtactgacatgatattcattcatatacccctgtcttccaaatgcatagatgtacaatagctgtcaggattgtatctccctgggtctcgtttcttatcaaaattgcacatttgctggcaagaagagagtggcacattgatctcaaactgtgaaataaatccatacgccttcagagaggttcttcgaatgtatggtcaagcattgcaaaagccgctgtgtgtttggaagaaaggtgaaactggaaggtctttggctcagggtgccattaggagtggtgtcggtggcagctgtgggccatcatggtacacatcctgcgtcaactccaggcctccccacaatcccatgaacagcaaagcccctcatcttttgaatgctggagaaagctccgtacgtgtagggcttcgccatcagtttaaaacgtctctggaattctttgattattttaatgtgctaatttcttgagctttgtttttgtgctgtctttgattttccactttcgcctttattttacgccattgttggaagggtcaaagcatcccagagcttaatggctctcttgttcagctattgtggggggaaaaagagcaaagcaaacaaaacaaaacaaaatatccttttttttgttttgctttttttttaatttaaaggcatccaaaaaattgtttcttttgcctttgatcaagatcatataaacataatcagtgtttattgtgtttgcataatcgaaaatagcaggaaactgatctcagattgcatggagctagaaaagattaagcctttccttcttggcagagttctacagacacacaaggttggtgtgatggatgcagcactcggtatccatgatgtgttcgggaaaatcctcagaagaaacttgcattgctttctggggaaattcctgaatacaagtggcaatgagatgcatgaaaattattttcagctgatgaatactgtctgaacataactattgctggggtgtataatttaaaatctgtagagtgaagtgtgcaatatatgggctttgggatacaacaaatatggatttaaattctactcctcctttttatcatctctctgcccgggataacttgtttcatccccttccctgagcttaagccccctcaactgtaaaagaaagataacaacccttacctcatatggttctagggaggacaacatgagataatacacatccaggcagtccccaacttaaaagtggtttcacttactttttttttttttttttttttttttgacattatgaatgacgtgaaacctttctgttttttcacatttggtatggtattcaatgaattccacgagatattcaatactattataaaattagctttgtgttagatgagtttgtccaaatgtaggctaatataagtgttttgagcttctttaaggtagagaagacaaagctatgatgttcagtaggttaggtgtatggaatgcaattttgatagaatattttcaactcacgatgagtttatagggacataaccatatcataagtcaaggaaagcatgtacgcagagcttaatagagtgcctaatacagagtaagtgcttaaaacatttttttaaagtgtgatacaagttctttggagagcctgaatgaattgggggtatggccatatgtaatatgttcagtgcagcaccattctttaataaattacaagttggtctatttctttgttcctttttatttttatttttatttttggaggcagagtctcactgtgtcacccaggctggaatgcagtggtgtgatcacagctcatggcagctttgatctctccaggcttagatgatcctgtacctcagcctcctgaatagctggcagcacaggtgtgtgtcaccacgcccagctaattttagtatttttggtagagacgaggtcttgccatgtagcccaggctggtcttaaacccctgggctcaggtagtcctcccacctcagcctcccaaagcacttggattacaggcatgagccacagtgcccagccagatgtaactatttaatgaaatgttgattggggtgtgcttgcttcccctgaagcctgattcttgatctttgttctggactccaggaccaaagatatcattgcttaatcttgcgaacaactctggaagatccttacagaatgacttgctttagccaaatcctatggtaaggcaaaacactacctaaaaacaataataagcataattgtcatccagatatgttgggaccctacagagaaattcagaagacaatctggctggagtttacagtatgtacaacagcagtcttggttaggccatggtattataattcagcaacaacaccaataataatattggtggttaaaatttcttgagtatatagaatgttccttctagtatgcttaaggcttgatatgcatacaatctttatggcaccctgcaaaatccatgagtccactgctgttttccaaataagaagatgggggttgtagtagtccattctcatactgttataaagagatacctgagtctgggtaatttataaaggaaagaggtttaattggctcacagttctgtgggttgtacaggctctgcttctggggaggcctcaggaaacttataatcatggcagaaggtgaaaacgaagcaagcacatcctcacatggccagcaggagagaggaagacagaaaaacagagcgagaagggagaggggctacatactttcaaacaaacagctcttgtgaaaactctatcaaaagaacagcaagggggatgtttgctcccattattctgtcatctcgcaccagacccctcctccaacactgagaactacagctggacatgagatttggggagggacacacagccaaaccatatcaggggtctagaaaggtaaaccaattttcccataacaatagagagaatacattataataagtaggacttgatccaaatctgagagacacccaaactcatgttcttaactatgagatttcgatacttggagtcagaagacttgggtttaagtttcagttgcagggaccttactcacatcttctaacctctcaaagccttgccatatcatctgttcaaaagaataccttcttcacaaaattgtaaagactgaatgagaaaatgcacctaaagcatctttgcacatcgcagagattatgcaagtataaggtgctatatttcgcattaacacctgagcatagatcattttcggattgtgtgagggatggtgaatttataaatttggtgatttttgatgaaaagaatcaatatgctgtctctttacagaggaattagtggttataagaactgacaatgcatttagagatttgtttttttcaataggacagaaagagactattttctttccatttataagaatatgaatgtgcttaagggaggacagattccaacaatcgagttgtttgctgtgatttgtacgccctggggatatggagagttgggaatgtagaaaaattacaattatggaataaaaaaagatccagggagaaggattttttttactgcctgttttgcttgtgtggcttggaacagggagtttcctggagggtgtggggtcttccttgctgaccctcgtgctttttggaggctcattggtaagccttgttgtgcctgttccttctgctcctagtccttaagaacatagctcttatccttaactgaccttttgcactgaatatgtgacagttaatccactggaaggttttagataggcagcatgtccagacactgccccctgcacgtgactggccccacctccgtcccaccttggtgttaatcccatggggtggattttctaggccagtctctttttagaatagcatttgctgatgtccctctaagagagtttttgggcatgtgccctggtttgtaaaagaagggccctcatggaggtagaggaaagaagtttcgcgtcccaagatctccaaggataccaattataggggtagctgggtacctgcctccctctgctcttcgtttctcaccgcaagagctctgctatgattttctccacatctggacttctttcctccctttcttgcatagctaacacccatgtgtgcttttggaccagtttccttgtcccgttcacaaaattaaaacttccttgacctcactgacttggttaagtacctttactgtatcactttataacttcagtaccttcatttgtagcttgcatcatcatttcagttttacaactttttatgtaatgatttggtttatgatactcttcccccaaaagactgtaaaggccatgcagatgaggaccaaatgtgttttttcttcctacgcatcctcagcatatgtgccttttatacagtaggcttttaacagtgactaaaaggaagagtgagtcggtggatggatggagaaatgaatgaatgaatgaatgggttacacaaccagcctgtccagacactgattcttttacgtaggctgagattcctgaggtaagggacaaggatatcaacttgcgttagtttaccttatgcactccatcgcagcctaaactgtcactgattacttgctgcccttagaatacaagctctctctgtcttccttcccctcctgccttttgcaatctcatttcatgctttgctcatttgccaccacaatacttaagccaggccagaattattttcagtgtttgaaagttgcacacccacttctcccttgcagattctgtacacgcttttcctccatcaaaaatgttttattctgcctcttcaaacattgcattttcataatcattttcagacctctgcctacatgtccctttttcatggaagccctccctccctgaatcctctaggttggacaactttcccctgtagtccccttgtatagcaccttgcatttccctccagatcacgtcccaaaattataatgaatatatgtttgcatttggacaatggcctgtttcctccactcaggagtaatagctacttgaggaaatgccttggtcatcaaaaagtgtctggctcctagtaggtactccacaagcagttatcaaataaaattgtaaaacccaggcactctttatggtcctaccaaaaccagtgacttgaatgggagatatttagggtcaaggaagaaagaaggcaggcatgttcatatttatttacctcctgtgggtttgtgatggcccctccttcttcttgggctagagtcagagccactttctcctaatcccctataggttaagctgagtaggtgataaagcccaagtcatagtagcataagcacaaggaattctgattatgttaagaaactgaaaacttcaggagtggttttggctattggtcattgctgaatctaagggtttgcataattactgtagggatgtcctcagtccgtggattgttttgactctctttggtgtcttggttttttgttgttttggtttggtttggtttgtttgtttgtttgtttgtttgtttgtttgttttgagacagagtcttgctgtgtcccccaagctggagtgcagtggcatgatctcggctcactgcaacctccgcctcccaggttccagtgattttcctgcttcagcctcccgtatagctgggactacaggcccatgccaccacacctggctaatttttgcatttctagtagagacagggtttcaccatgttggccaggctggtctggaactcctgacctcaggtgatctgcctgcctcagcctcctaaagtggtgggattacaggtgtgagccaccgcaccccacctggtgtcttgatttttattgctccttgcatatagtcaatggttctgagatctgacaggaaatgcctgatggaagagctatggcccatgcaggatctcacttcagaccttaatccttaagtttgtgtctgggaagatggggtacttgattggcaagatgctcgtcacttcttgctcacctctggatgtcaatccacaagttttctttggtatcttcactgtatgaaaaacccaactataatattacactcaagtacacacttataggagcacactttttatatagtttctatataattttcctaccccatctgtcttaggtcagatttcctagggataatgccatgcctgagatgggtgcaagtggtgaattgaaggaatgctctctggacaatgctatagggggtggtggtaatgaatcaggataaggcagaggaaggtatggtttcagggggaaacatagcctcagcctgatcttgtaagaagatctggattattcattgtgccaaggattatttcactgagtcttatccccaccccgtttcatccatctgtctttggccacaaggtgtcccccaggaaggggtggtagccgccttaccccttacctccacctttactccaggcatctctggctaaggtgaatcatgccagccaagtccaaacattcagagaagaattcaggttgtcagcagttagctgcaaacacccacgtcagcaggaagatggttcatcaagctagggaggatggctgaggcaccagctttaaggagtcatagaatggcctggtgtggtggctcacacctgtaatcctagccctttgggagtccaaggtgggcagatcacctgaggtcaggagttggagaccatcctggccacaatggtgaaaccccatctctacgaaaaataccaaaattagccgggtgtcctggtgcgtgcctgtaatcctagctactctggaggctgaggcaggagaattgcttgaacccaggaggcagaggttgtagtgagccaagatcgtgctactgcactctagcctgggcaacagagcaagactccgcatcaaaaaaaaaaaaaaaaaaaaaaaaaaaaagagagaaagaaataaaaaatagtcatagaatgagaaaaaaatctgaaattagagggattgctgtataaataatgacctctgcttgtattttctgagtagttccaattttacccagtcccttctgtctccttagtcttcagcctgaatctcttgcttacctcccctaatggccatatggggaacaggattttattaaggaaacctcgaaagggttgacacaagagtcaaacccccacacctttagatgcataggcagtgaaaccaacctgtacttcccatcttcttgcgtttccatttatccattcctcttggggtccagggtcatagcctctctactgtacctccaacgggtgccactacagtgtctggattctcgatcaccacctcccttttcagtttactgatcaggcagtttcggagaccacgccagggtttcatgtgccccggttgaggcatgaataacagcagtttgaattctcctttgtaattctcatccaggcaagtcactcttttttcctggtataaatgatcagatcgctgctgcagactcatccaggattcctctgccttattgtttttcaatccgtctacttccacgatcctctcttcccaccctccttgccgtcccctgcagccttcatgtctgtgcatacataaataaggctgttatgcacgcatgtgagaatatatacccatcatggtactgtgtgagcctgtgtacgtgctgaggaaatgtaatgggctgtggttgtgtgtttgtaggtgtataataagtttgccgcagactagggggataaatagagccatttgttgattcaaaccaatttttttttctcttgagttagtatccaatctgtagctaagaactgctgactacagcatatttccaagtgtggattttttttttttttccctgacagccaagacctaactcttgcctgatctatgtagatgcattgttcaaattacaaagcttaggtgacagaattgctctttttactgggagcccccaacacacctgtcatcagatagaagggagaatgcagaagtcatcactttacttagaaactcagcagatgattgaaattatttcttactactaattccccttttagtggagataagccgctttgttcagctgtaaatgaaacattagggtattaactgtggagccagaagtattggggaagctaagattttatctgcagtaagaacattttgggcaataaattgttttgttggacggaatactaaatctcttgagttacaaagaagcagagctcattaaggggaatgcttaaagcagaaaacaaggcgagacaaaagcttattacctttgttgtggggattgagggggtgtttgcaggttctcatgtatatgtagcatggaagacttatgcagtacagttattaaatagatgtgtctatagacttgcaaatgctctatgaatatgtccaagggacaaatacatttctgaaatatcaatagcaatctgcaataagttatgaattttggcgtacatatttaccctcaaagactagatttttgtttcctgcgggtgaaattttcccgtctctttgccacatccttcagattaattgactggcatggttacataaatgtttgtaatagagaagagtaagtgccagggttatccaaaatattgtcgcaaaatacacacctaaattaagataattatgtgttgggagcatctatcggcagggcttggcaaggaggggagctttctcttgatggagaggaggctctttctgggacactgaattcatgaatggtgggttctggattccccagggtgctctcagcttgtaagtgtcaggggaggggattgagggctgttcttttgccaataaccagggcggaaggaggacgagaggaagaagacagtgccttcttttccctggagttagcaaccctctgctgtgtctccaagagcaaggctgtggcagtacaactgtctacctgtctacaccggctgctccttcttgcctttggacagaagatgacactcacaaactgtggcccctgagcaacagtgtaaacgggcatacctcagttacaagcggattcaaatgtaatgagaacaatttcagagctatgcattttattcttctgtttttctccctggatgactcagggcatcttttcacagactcccaccctgaaggtttttattgccatttctgcgcttccctacacgtcctgattcataagtggatgctcaggacacagtcactcagagtagcttaatactctgcggacctcacgtgctgagttctcattctggacttaacgttactttaagctcagtttgtacctttccttggttctgtcaatggaaataaggacaacacttctcaaaacacagcaggtgggctgagagtggtgacttacacctgtaatcccagcactttgggaggctgaggtgggtggatcacttgaggtcagaagttcaagaacagccttgccaacactatgaaactgcatctctactaaaaatacaatcaattagccaggtttggtggtgtgctcctgtaatcccagctactctggaggctgaggcatgggaatcacttaaacccaggagacagaggttgcagtgagcctagaagatgccactgcactccggcctgggctatagggtgagactgtcaaaaagaaaaataaaagaaaaaaagaaacatagcaggaaggtagcagtggacaaatgaagtattggaaacacatagcctacacattcatgtgagctttaggagaacgtgaggtctaacttgcttaaagaaaacttagcacatgaaaaatgaaaactatttttttcagtgcatgagtgatcatgatctctttaattaaaagtgcactgaattgtaagatcttttaccaaaatgttaccatctttatcttctatctctggtgctgagtgtagtaacaggaagagatttcgaagtgaagactttagtaagatagaattgtgtgtattgtgtttaaatctggggtgtatttaaaatgtaattgaaatcacaagatatttaacatgctattcactttgcaagtgacttttcaggaccacttatctgcagactgtaggacaccagtctatgaacgttggcttataggagcaccaggtctccagttgagttaattcctcatacttgtcacatagggggcatactaagtcttcctgagatgagtagaaacatagatccacataaaaatgaaaagaacccactggtgacagagggtctcagagcctccagtttttttctgaactttgaaagtcagtaccaaagagtcagaactgaatggaaggacactaaaatcaatacttttcaatgtaacatcacaagcgttgggactctgaagaacttgatgacacatgattcagaagcaaagtgatatttacataggaagactgtcctcgccctctggaatgattttgacatgtgtattcactcttagttttggctcttagagtttaagtaatagatttacggtggtatgaacacaggtgttaaagagttctgggttcaagtcttgtccacgtcccaagctgtggaactctgaataaacctcttagtctattggaaccttagttttctcatctgtaaaacagatgaaactacctgattttttaggccctacttggctcttaaatttctcggctcagtgaacaatgcaagctttatgttataaaccaccaagacatctaagcttcttcccttacggccgttagtggattaagcgatatcctcagagcaactgtttggtgatttaacctcccccagttgctctatttcctgggttgttcatgagtaattgataaagaatttgcaacactaggattccacatggaagaaggaaatgcctcttttggacccatttcaaacaagcattggtaggagatgcctcagacgcttatgcttaaagcatcagtatcattgcctgacagcttatcacagtggcaggagcatagggttgaatcttatgtttttctttccctctgggtgacacttacaggatgcttaagtttgctggacctcactttcttcatctgtaagatggggacagagaactatctcagtgttacagaaaatttgaagatgaggctgaagatgtaagattttgttaatgtctacagtgttaaagaatctcaatatatggtggctatgattattgctattcttatattaacttggtgataggcatcagtggttgaattatctggagaacccagaaaacagaacagatcttgcaaattcagtcgcttacccagatgttagttgtttgatccccagtgtgacaaatgccaccttcaatctctctaacatttctaggcaagaaattattctctcaggagactgccagagaggcaattttgagcttgaaacttattgatgtgatgggctatgaccaggcaacttccgtagtcggggcatgtgctgagtctgactacagtctgactacaaatcccagctctagccccatgtggctgggggccagctattttcattgtggggttagactccctggagggaataattctgagatgacccttttaaaatgtaatccttgtactaaagtggggctagagggttccctattcattcatacggctactgtaacaaatgcccacaaacttggtagctttataacaatagaaatttactctcttccaattgggaggcaaaaagtttgatgtcaaggtgtcaacggaaatagtagacactaggaactacttggggcaagtgttgagtgactgttgggtactctgctcactttgtacctcaaacctcagcatcacgtaatatactcatgtaacaaagctgcacttgtacccccgaatccaacatgaaagttgaaattatatttttaaaaagcaatgtcgggccaggtgcggtagctcacgcctgttatcccaacattttgggaggccgaagcaggtggattacctgaggtcagtagtttgagaccagcttgaccaacacggagaaaccccatctctactaaaaatacaaaattagccaagtgcgatggcgcatgcctgtaatcgcagctacgtgggaggctgaagcaggagaattgctttaacctgggaggcagaggttgcagtgagccgggatcagactgttgcactccagcctgggtaacaagagcagaactctgtctcaaataaataaataaatgaataaataaataaaaataaaaatgcaatgtcagcagattggctccttatggagactttggatactttgagggaaaatccataccctggctctcttttagcctctggtggtgtctgtcaatacctgacatttctgggcttgtagatgcatctcgtccatttctgcctccatcttcatatggcattcccctctatgtcttctgttctgtgtgtcttctaagaatttgtcgatggatttagggctcacttaagtttaagatgaccccatatcaagatcttttaacttgattacatctgcaaagaccctcttcccaaataaggtcatagtcacaggcacgaggggttaagacttagacatacctgttgtggggacaaaattcaatctactgccattttattgtgaactatccttgcatggagaaacagttcattttaacttagaatattcaacaacacaaagctaacacttttctgtgggcgatgactatgtaccaggcattgtgctaattgataaagggcattatattttaaagttttatcttaacaattatatgaggtagggattatggccttctctgatttattgatgagaaaattgaccctcaggaggggaagaccatttttcttagtcacccaactaagaaagtggcacagttggtatcctaatccggaattttctgattctgccatttatgctttgaacaattatgctagaagttctcaaattttgtcatgcataagaatctcctggggttgttaaaattgcaccttccccaaagctcccatctctacagagattccgattctgtaggtagaggggaggggcaaggataggcattaaaaataactgcattatgcaattctgccccctctctcctcccactgaacccatctttaaggaaactgcaacctcagcacaggggctagcagacatattcagatcatctctgaagacagaaatcctcaaaagtgaaaaaacacaagaaagtccaggttgcttttttttaatttaaatttatagtgaaagctaccttggcccacagctttctccctcctggtcccttacaaatatattcctttccggattcttcaagaacacagtttgtattaccatctcccagcaagaagaaatttggaaataggtggtattgctcctaaccccttcctaaatttgagtctgctcattcttcagccatttggaggttttccacttggatgatgtccacagagctaggggaggaaaaattcttctgcaaagcacagtggatgaaccatcagtctgcagtaatccagtcaattaaaaatggatttcagttcccagcagcatggtggtgatgttaggaggagtcagtgtccacaatgctgttggtgcgcttgcccattaagtgatatttaggggatcttctgccatagcagaaaacagtgcggttgatgatctttgcaactaaagaagcaaaattgaagtctcacataccaccacggtattttatttctaatatgttaccctgccaaccttggaaccccgcatgaaactcaggaatgtgaagggacagaagtatgatatattgcccgatgcagctgattcgagagggggtatccaaaatacagtcccaagacatccaggagaatttgcctgaagagagggaacatgtaatggtattagaaaatccagaagatctaagctgcctgatgaagctattttttaaaaaatgtatcttcattgcatttatttttcatcacacagtagttggcgtaaaaccattctctctgtgaaagaagtcaaactacaaataactatgcaaaaatatatagagaaaaaggtgaagcttttcatattttaaatagcatctgaattacattgcttctttcaaggaggtaaactttgttgagtatttagcagttgttccagacttttctctgataaactttcaacttcaacataaaataatgataggtgttttgggaagccatagatgggatggctgtatggatcgatagctagatggctaaatatgttgatagaccctcaaacagattaggtaggtaaaaaatagaaaaataaaaagatagaaaaatagttaacaatgcaagcctctgggcagaagaaatttttccctatgttgtttatgctctgtgtgattctggcaataggtaaatgcattgattagcttctttgaacccacttttcattatctatcaagtagaggaaaacagtgtctttgttgcttgcctccagaattgaggatgacagtgaggtaatgaggaaatgtatttgaaaatattatggactcaacagacatattggcacaactcaggagatgtcataggcccagcttctataagatgatataacctagcacaggaggccaaaagagtttccaaattgcataaaggaaacttgattgtcctttaaaaatggctctggagaaattttatacccaggctcatgtcatctctcagtgaggttaaatctccaaaagaggaatgtcatctgttaataatacatcaagcatgcagcaggtagatgttcttttccttccctttaaaaagttatttttattttattttcatttttaatgtatattttaatgatgcagagtgtcatgttcctcagagtcagactgtatcctaaagtaatggtttggttaaaatatagaatggatttttgccaaattgaaaaatatatatattgtgttataaaactcgagctgtgatgagcaactctttgaaaatacatttaagtactcactgagtcttgtctgaagactcacctgtaagggagggtcaactaagttattcagtcccggacgttgttaactgccctgaaagtggtggctaataatttccttttgaagtgaaaagtagtaagtatgttcctgaactccattatcaatctttaataatttcagattaaggcattgtacttctatacaaaggaatatcatctttgaaaagtggtcttaaataaaatttcacaaataatagtatcccatcctcttgcatttgagaatttctgccgagagataggagaaaataaagactccttgctgctgtcaggaggtcatcgttgggaacagacttcaaagtatgtgaactttggtagtggaaagatgattattccttggtttccagatccttatgcataatttgaatatgagtggctttcaatgctaagtatatgagactcccctctgttaattatgctgtttcagatgagcctaattggacagccactggcacctaatatggtaaatatttcatataacgtgactttgagaagaagggtgcccccctccttaatcccatttgataggatggtgtaacctcaacagcagggatagcttaactctagaaagagttgttatttatctgagggcacctgtaagggggacatcacctaactcattcagtcctagacattgatgcctaaagtataaactgtggtctatagatgtaggaaggcttggaggcaattctagaaacactgcagaaaatttgcagtttctcctccaatctgatcttgaaggaggaggtgaacctggaactccccgttcacgatgcagttgtggaataaaatgaggcttgatttctcctggattatctgaccacttctttttattttcccccggctctatgggggtacaattaacaaatataaattatgtacatttaaggtataccatttgatattttgatatatgtatacattatgcagtgaccaccactctgaatccagtgaaggtatctatcagctcagagttccgttttttggtgagatcacttagaatctagtctctcagcaaacttcaagtatacaatacagtatcattaattgtagtcaccgtgctatacattagacgtctagaattcagtcatcttggataactgaaattttgtattctttgactaacatctccccattccctgctcccttcagcctctggcaaccactcttctcctgtctgtctattcctacgaatttgagtgttttagatcctgcatgtaagtgagatcttacagcgtttgtctttctgtgtctggtttattttctctagcataatgtcctccaggttcacccatattattgcaaatgagagaatccccccccccccactttttttttgcccagtctggagtgcaatggcacaatctcaggtcagggcaacctccgcctcccaagttcaagtgattctcctgcctcagcctcctgaatagctgggattacaggcacctgccactactccatgtgaattttgtatttttagtagagacagggtttcaccatgttggccaggttggtctcgaactcctgacctcaggtgaaccacacacctcagcctcccaaagtgctgggattataggcgtgagccaccatgccggggctccttgttttcttaatagatgaataatattctagtacgtacataaattttaattaaatattattcttttatatatatatataacctttttaattcattcatttgttaatgggtgcttaagttgtttttattattgtgaatatgccgcagtgaacatgggagtgcatatcctgatttcatttccttttattttattttattttattttattttattttattttattgagacggagtctcactctgtcacccaggctagagtgcagtgactcattctcggctcactgctacctccacctcccaggttcaagcgattctcctgcctcagcctcctgagtagctgtgattacacgtgtgagaccccatacttggctaagttttgtatttttagtacagacggggtttcaccatgttagtcaggctggtctctaactcctgacctcaggtgatctgcctgcctcagcctcccaaagtgctgggattccaggcataagccaccgtgcccagccgacataggaatttatttagtgtcaccttgtaggtcactgacctatcagggacaggcctccaagcttctgacatccagtgatagcttcttagaggtgaatgatgacggctcctgttaacattttctggcaggcactgcgtgaagcacttggcataaatgacctccatagataggtgctattatcatttctgcttcacagttcaaaaagtaaaggcttaaagaatgtaaataatttacacctgagtgaccagtacctacacctcagaagagaccctgtctctcagtcatgctgtgctgccagcgttggaaataggtagcaagtctgtggatattaaaagaatgctttttcagaaaaaacaaacaaacaaacaaacaaaaccgaatgcactttttaattatctgattccttgttgtcacgtctttatcaggtagaatgcacaataggttatcattcccttttcactgacgcagaaacagatgtgggctctcctggaatgtgttatgaattgggtgaggggtgccgttcaggatggcgttcctgggtcaatggattttatttccagtgagtagatatgtgggcgtaggtcctcgtttctcatgtctactccctctagtagagatgattttactccacagcaggaaagatgcctgctacaccacaaagggtattatttcggttacggtaataacgcataagggtgtgttttcaaagctgggcagtgcatgcttgccaggttgcagggtgattcttgagagctttctgggcccatcctagagaaaaatctccagtgaggctgcagttgcaatttatttcctcattctagcaagaaagctcttgacgatacagcagtgtttgttttctgcttggtaaagtagaaaggaaaacagcagaaattagcacggcgcagcgctgatgccagcccagaggcagggcctctcctggtagcccccccgctgcaaacctttgccgctggaaagccttcagctgcgatgagattagcagatgcagcagttcactccaaggcgctgtgcagttttttccctgttccaccaggtgttgccagagaacattgagcggagctgagctccgggcgaagtgtgttcccagctgctctggaacactcgggctgttctgaaggcagcaattaaatgagttatgctgaccggagcaaccctcttccttgcacgtttaaatatgcctcccgtgtgcgcctcatgcctcacatttcaaataaacacatttttgatgtgcctttggatctgctcacacattgttatattggaggaatcagagcaagcaaggctgtgcggatccaggctgcaactcaggtcccagctgcacctgtggtcagccttccctgttaccagaaagtggacagtaagcttggatgacacagagggggttctcagtgctagggtttttgcctggtaagtaaaggtagttccttctaacacctgtttcctttccactcttccatacctggagcattgagatcacagtcctaggtctgtgattctcaggcagttgtggctctgtgtccccagggtgcatttggccatgtccagagacatttttagttgtcacgactgggcagttgagggatgcaactgacatcgagtaggtagagcctgagatgctgcaattgatcctgcaacacacagagcatatcccccacaacaaagaattacctggtttgaaatattggcaatagtgaagggaaggggagaaaccccattctggaggtgaaggctttcttggcaagatacccgcattgcccaaaacacagagtacaatctttgaaactgtggtttttccagaaaacctcatctagatcatgacacctaaacatcatgcctcaccaaggtaacatccccaccaaggattaaagaagagttgccatatgccatgggcctactatgtgccaaataccttgttcatacggtttctaatccttacagaaataatgttgagtgggattactgcactgcgttatagaagagtaaaccgaggcccagagctcttgctttccttgttcagaatacctggctactacgtatgggagccttgttttcatccagtcccttccttttactgtgtcaccctgtggcccagagggtggatggatgtgggtttccaaaagaaaacctactttcgaatcttgcttttgagtggacagtaaattagagagtgatgcaaaaacatttagaaggaaaaacaattaaaaaatacaaactttccggaatccagtgttggcctgcctctaaaactctctgccttccaaagtgaccacgcacccacatggcagattgttacctgacaccttctgagtcccttttcagttactgctttggcaaattactacaaattccgtggcttacaacatcacagagtgactctcttagcgttccagaggcaaaaagactgaagtaggtcttactgtactaaacttgaggcttctgcagggctgtttcttctggaaatctaggggaaagtccatttccttgcattttctagtttctagaggccacctgctttccttggctcatggccccttcctccgtctccaatgctatcagtgtagcattttcaaatctctctctgtctctgcctctgcgtttgtatgtcctgtgatctcttaaggacccaagtgagtatgctgactaaccctaagataatcaaagataatctccccatctcgagaccctgatcttaatgttttttattttcataggtttttgggggaacgggtggtatttggttacatgagtcacctttagtggtgatttgtgcgattttggtgtgcccatcaccagagcagtatacactgaatctgatttgtagtctttgaatcacatccataaactccctcttgccaggtaaagtgaggattaggacatgagcatgtttgggagaaggatgttactctggctaccacaggtagtttagagctgccactgctagggataatgggaataaagtaaaggaaaagcatagaattttgacttcaagggatttgtatgggtgtgtgtgtgtgtgtgtgtgtgtgtgtgtgtatgtgtgtggtgcagagaagaatggcacacagcaaaaagaagccatgatactaattattctcagacaggtatgattatcatcaatcatatgcatctttgtatccccagaggctgctatgttgcctggtaagtggggtggtaggggcacagtttgtatttcctgtgttagtttttgtagggaaggtaagagcagtgttcaatagaaatacagaagaaagactgcttattatagcaaccaaaatatggcagcatacctattatcttaattgccgttaacattcaccttaatacaatgctggttgatatgcagaataataacctagagactgtgcaagtcttcacagtgccttctgtatcttcatagattcagtctattccattacactctggtgttgtacaggttttcatatttcactgggggtgggaaaactatggccctgggacctaatctggcctgcggactattttcctagacagaacattatgggaacacagccatgcccatttgtttaccaatcgtgggtggctgcttttgggccgcaatggcagaattgaataatcacaatgaatgtatggcccacagtgcctaaaatatttattccgtggctctttacagaaaaaaagaaactgataacccttgctttacacaactggatgctggcaagctcccttagggaggacagaaaggttgattaaccagaacacaacactctcacaacatgggggtcagaacatacacattctttgaattacagtatttgtgacaacctcctattgaacgtcttactgcaaataataaaagtctcaagttaagggagactgacactcaaatcatttagatttttttttctcagctatgtttagtgagataaattgtgcttcactgcagtgacttgtagatgacaatacagcagaagaacttttaatacggcgactgtattcattttgaaattttaaaaaatgttagactgtgtctgagcacagtaaaccattcaaaactgtcactgcacagagatgaatgggagaaacagtgcatctctgaaaatattccgtaaatatccttaaattataacgtctgtttgatctgctgagaagtagctaattcccgacacttttcatctctctagactgcccatcgattgtcctgagtattgcgattgctgttcctgataactgacttgataatttaatttaataagaccttatcttggtctagaggagcaatcaaggctgctatctcctacagcacgtttctccaccattgacattttaggccgaacatgtacttttttgttataggtagacatcccatgcattgtaggatattgaacagcatccctggcctcctatccactttatgccagtagcatcccctccctccttgttgtgttgttactaccgaaaatgtctccagatactgccattgtccctaaggcatgggggcaggggggtggttaacatattccccagataagaaccattgttctagaggtatggtgttggaagcgcttggcacctttcatgtaaatcattgcatgttgtcatcccaggtgaacttttcttcttttctttttgcatccccgcccgtcaattcttcccctactttctcctgggctgggcttttcttcatgtctaaatgcactgcaaagacgagattgccttgaactcctccagcttttcccgataaccctgagctgcgctgtcgctctaagccagatcagcagaatccggcctgtgatcaggttccgggagctggaggacctctccgtctcaggctgctgtgatcagagagtctggagaatgagaatctctctgatgtggtcttatcaggctgagcctaatgtcaaccctgttagaggagctttgtccgatctgcctgtagctttgttctgaaccgttcagtaacagttcactggagcagaaagagccctgtgaattgatattataaacccacatgcctgttttattcattgtggaggcaacagaatataacacaagtatttatttttagtggttggagaatggcatttctttccccgtccccattgtcacagaatgcagaaaacagcacagggctcctgaacacaattctattagaaagctgttgccagttgttcctggtttcgattattttgcactatcctaagcagtgtatgtctgtgcattgaatatgtatgtgtgcgtaatacatattacgttcgtttggatggtcttaataaggagccacataccatcagatgtaatccaatcactataggccagaccttctatccttggctattcccttaaccccatcaccaccttgatttcgttggaagttagattttctagaaaaattcatgaaacttcaacatgcttcattcattccttgctctgggcattccttgctgaaggtcaggagctgtgaaatttctctttagtcccattgctttgatatggcagaggctgggcaatgaagaaattgaagtgtggaaaaatggagttccggcaatgtcttaaatgaggggaggggtcttatcgaggaggctgtgcctgtggtctgagctgacatttctctaacagtgagaccaggaagaggaccaggggacacagctggatggctgcaataccagggtcccttcagctgcaattaaagctgcatcttacattggagtcttcagtgatgatgatgatgatgatagtagtagattgaacataggaaattgctgtcatttgacaattgttaacctacataaatgtcactttcctacagcgcaacttaataattgtacacataatagctcatctgcgctgggtgaccgctatggtccaggcacagtgctgtaggcactgcatatgtgttggctccttagaccaacacagccactgtctattacagatactgttattgctctcacttgacaaataaggatgctgagctgtgggaataatttgcccaatgacactaaatggcaaaactgggattaaaacccaggaccttaagactgcagcctcggctgagcgtgatggctcacgcctgtaatcccagcactttgggaggccaaggtgggtggattacatgaggttgggagttcgagaccagcctgaccaacatggagaaacccggtctctactaaaaatacaaaattagctgggagtggtggtgcgtgcctgtaatcccagtaaggaggctgaggcagcagaatcacttgaacccagaaggcagaggttgcagtgagccaagattgtgccattgcactccagcctggacaacaagagcaaaactctatcccaaaaacaaaacaaaacaacaaaaaaacaaactgaggtctcttctgttaacccctatcctcctctcttggttggataacagttttagactgatgctcctaattcccacagaggggcctgcattttcatcaggcttgaggatcatgagttttcacgtgtgtgtgtgtgtgtgtgtgtgtgtgtgtgtgtgtgtaaatcaccctaattgtggggagtactaataagttccatcgatctactcttcacctagtaatcaacttgaattatttatttatttatttatttttcgagacagagtctcactctgtcacccaggttggagtacagtggtgtgatcttggctcactgcaccctctgcctcttgagtttaagcaattcttgtgcctcagcgtaccgagtagctgggactacaggcgtgagccaccatgcctgaccaatttttgtatttttagtagagacggggttttgtcatgttggccaggttggtcttgaactcttgacctcaggtgatctgcccttctcagcctcccaaagtgctgggattacagccaccacacctggccaatcaactttgaattctaagaatgggtgacaaagaactttgtcttgagggttgtgtgttaagcaagagccatcaggtctcatcctcctcagtttagccacaattccacattagtttccccgacagtgtatggaatttcagttctacactcttccttctctaaatttcacccggtctttcagagaggagacagggccctaacagacttagcaaagatgttgaacacatgaaaatgggaagtactgtttaaaaatggaataactcttttcttcccccaaatctataaccccagtctaattgtaagaaaaacatcagtcaacttccagttgagggacatcgtgcaaaatatctgactgtcaaggtgatcaaagacggggaatgtcaggccaggcgtggtggctcacacctgtaatcccagcactttgggtggccaaggtgggtggatcacctgaggttgggagtttgagaccagcctgaccaacatggagaaaccccgtctctattaaaatgcaaaaattagctgggcgtggtggcgcatgcctgtaattccagctacgtgggaggctgaggcaggagaatcacttgaacccaggaagcagtggttgtggtgagccaagatcatgccattgcattccagcctggacaacaagagcaaaactcctttcaaaaaaaaaaaaaaaaaaaaaagatagggaaaatctgagaaactatcacagacaagaagaaacttcagagtcacggccgcccagatgccatgtggtgtctcagatgggatcctggagccgaaaaaggacattagatgaaaactaaagcaatcgaagtataggctgtagttaatcgtgatgtattcatagtggttccttagttgtgaacatgtaccatgctactgtaagatgttaataatagtgaaaattggctggacaccgtcgctcacggctgtaatcccagtactttggaggactacctgaggagttccagactagcctggccaacatggtgaaaccccatctctactaaaaatacaaaaattagccaggcgtggtggcgtgtgcctgtaatctcagctcctcatgaggctgaggcaggagaatcacttgaacctaggagctagaggttgcagggagccgagatcgcaccagtgcactccaggctgggcaacagagtgacattctgccaaaaaaaaaaaaaaaagttaataataggggaaattgtggagtacatggaaattctctgtacaaacttcacaacatttctgtaaatcgaaaagtatgctgcaattaaaattttatttttaaaaagggaaaataaacataagcccacacaaaaaatatggactaatcaaatactttctagatttcgtgtttatagcgtttctcacttagtaatacaaagcattctatcttagatttctcccatgtctgttagactcccaaaggcttttaccccatggtaaacagcataaacaaatttgtatggcttttttaaattcagattttcccaggctgatttaatcatggaattacgactgggcatggtggctcacgcctgtgatcccagagctctgggaggccgaggcaggcggactgcgaggtcaggagatcgagaccatcctggctaacacggtgaaaccccgtctctactacaaatataaaaaattggccaggcgccatggtgggcgcctgcagtcccagctactcgggaggctgaggcaggagaatggcgtgaacccgggaggcggagcttgcagtgagccaagatcacgccactgcactccagcccgggcgaaagagcgagactccgtctcaaaacaaaataaaaataaataaaaataaaaataaaataaaaaataaaaaaataaattatggaattattttacttgagaagcagtgatggggaaaaaaaatgtaggtcacaagcctccctgatgacaattcctttcataacaccagcttttcccaggacacaccattgagacaccttgacatcactacccagaagcattggtaacctctttgtgcctcaacactgattctcgcctgtaaaccattcctctcccctggccaccctcctgcatctgaccccctgcctcccttccccagtcttcctctgtagcaatgggtcccacacatccctgaatcacttgttaaaacctagatgtccagccttgacccccagagttcctgattcactgggtctgggatggggcccagaaactttgcatttctcacaagatccaaggtgaggtcaacactaccagcctggggaccacactttgcaagccactgagatgccctctgtctccttgtaaggctgccatccattccgccatagattccacgctttgctgccacccccctgccccctgcctgcccctttgcttgtcctcttgctattcccaggcactggttgcctgttttctaacataaatgtcaaaaaagtattcctcagcgggtgtggcattcagaaatggataggattcaaacaagcaaagggggttacttggtttaagagctcagtttaatgacaagagtattttccttgtagctttgtagagctggatcccaggtacctctcatgaagcccatgaacttggtttctaccctataaattgaggttgatgagactcatcactttggcttttgcgaggattaattggatttgcattcgttaagtgcagagcctggcacattgtaacagctcattagtaattactttccaaactccaaggagatggttctcagatgttggtgactatcatcacctcctgcagagatgtggaggtgcagagtcctgaccctgcctccaaagactcttactcatcaaatttgggagtgagataagaatctgtacatgttacaaagaaaccagaaaatcccaattcaaggggtctacagacaatccattcattcgttcttcacttagttatccaacaagtgtttcacatacacttccatgcaccaagatgggattgcaggtggtagggatacagaaatggacaaaaccgagtgctcaccttggtggagatgattggcagcctgccttacacaaggaactctatgttcactggccaggttatgggaagtggtacaaagttggagtaaaagtaaggtaagaagatagattggtggtcaaaagtctttctgagaagattacatgagaggaaagatggaataaaggaagaaaaatattgaaaaatcttcaattaaaatgtgattctttctaatgtgagccacagaatttaacacagatctgtagtagtcatcttgagtgtttttcttttgatagaaaagtgtgactttccaaccaatatagtaggaacttgttgaaggtctaccatatcccaaacacaatgtttttcaaatattgtttttattttattttatttatttatttattttgagatcaaagctcactctgtcacccaggctggagtgtggtgatgcgatctcagttcactgcaacctccgcctcccgggttcaagcgattcttgtgcctcagcctccagagtagctgggattacaggcgtgtgccaccatgactggccaatttttgtatgtttagtagagatggggttttgccatgttagccaggctggtcttgaactcctgacctcaggtgatccgtttccttcagccttctaaaatgctgggattacaggtggtgagccacggcgcccagcccttatttctaatccctgtaacagattatgcaagggaaggtgtttcatcccaacattacagatgaggggagttgtgaggagcttatatgatcacatagtgaatggccaaagatggctctttctatactctacagcctctgacatacaaagattcagacttcatttccaaagtcattagcagtaccaactgtaatcctcttaaggaactaattattttgttaccattttctgtatttattatattgccatgccccatggcttacaatcctggctgtgccttcaaatgtcccagaggcaggaactgagtgtctggggtattaaggttttctcagatgatgcatctgatatgcatccaatgacaggtaccactggctagcattataatccaagataaatccatatcttctgcctgtggaaccagatggagttctggtatcaaaatacagatctagagggtagctctgagccagtgcacttgaagtttgtggtcatgatgaacttcaagctcatgtaagagattactgaatttcccagcaatgagtaacggaccaacctatggagaaggcagacagaatggcaatgtggaataagcacaggccctggcatccaaactgggtttgaaacccacctgtccacttttctggctttgtgatttggggtgacacacaaaatttataatatacgtaatattattaagaacacagtaggttcccagcattgtattctctgttctctctcttaaaagtgccaccctctaccaagaagcactagttgaattccaagaaggcaagaaaagggctaccatttcttctctacccagcaatggttacgttaattttccagtgcaggaaagtggaagaaaataagagtatatatatatctttccaggcccttctttccaaagttatttgactctaaacttagcatcctctcccgggaagatggaactgtcctttttgtgcatttgctgtgataactttgggcccagttacgcttgctacgaagcttgggctggtagtggtttaggagaaaaaaaaatcaagtgaaacttaggactgtcttctctcttctttcccgaacttcatctttgcagagatgatctcctctttgacatgcagagtactcaggcctctttttctcttcttgtcctttctttcttattaaacctccagccccccaatctgaaacgattgctcccattttgtattccatggagctgtaatatttgcccaatgatgagctccattcagcagtttgttaactgaaatgggaagtgacagattcaataaaaggaaatctctgtgccaaggaaacagatattatttctcccctcgctctccctttctgtgtctctcagactactctgtgcccggaatccagagactctgagcttacggacaagtcaaagctttctgttgatccatgcccaactaatttgatcagaatagaggtttttattccctgtagttcttctctctcatgcttactgatatgattgagtgcctgggagtcacccccaacctctgctgattgttagagggaggaagtgatgtacaggaaagtgggtacatggtgtgctgggaggggggccttgtagacaagatggggacaattgtaaacagaagatcggggctaatgtaaaagtgcaagatcctcttctggggacagccttcttgtcttcatggatagtgcatatagaaaagcacccacgattcccagtcattgaaaaccagaggaccccagtggcaatggatacccatttaatctctgagaaaatattaatgagtaaaaggcaagcgactttagggatgtttttttttctttccacatatatgtggacactagttgtgaataataatgacaatgacgatagtgagtagatatcatgtatcaactccctactaaatgccaaggtttggtctatgcacgtaacacatattatctcattcaatccccgacaacaaccctctgaaggaggtgtccttattatccacattttatagcagaaaactggggcttagagaagtaatgtgtccaagaactcatagctggcaggtaggagccctgagattccagtgtggggctcgtaaacttacactttgcctaaattttttttaaatgattgagttcattgttcatttatatttaattttaagaaatagcacaaagagtccgggcatggtggctcacacctgtaatcccagcactttgggaggcggaggcgggtggatcatctgaggtcaggagtttgagaccatcctggccaacatggtgaaaccccatctctactaaaaatacaaaaaatactggctgggcgtggtggtgtgtgcctgtaaccacagctacttaggaaactgagacaggggaatcacttgaacctgggaggtggaggttgcagtgaggtgagattgttccactgcattccagcctgggcaacagagcgagactctgtgtcaaagaaaaaaaaaaaaaagagatgaccccatatcctgttcccccagtttccccagtggtaacatcttatataaccaaagtacaccaccaccaccaggaaactgaccttgatccaatgcatccgccttattcggatttcaccagcttcacatggtattgtgtgtgtgtgtgtgtgtgtgtgtgtgtgtgttcacttctctgcaatgtctcacccatgtagcctcctgtgatagccaccatagccaacatacatcatagctccatcacaaagatcctaggctctactctttcgtccctgcagtgacctccctccctgctccatatctcaggaaaccttaatgtgttctccatctttataattttgtcatttcaagaatgctatataaaaagtatgtgaaaggcttcatgttggtcaccctctgtgcatgtgtgtggttgcagaattagtcctcacacagagcttgattgtctacttcacttcttgacgcactttcgttcctctgtcatctcccatctcccttttcctgcagatgtattgggttgagacttctggattaggtaccctgttggccctagtatgcagcctatcacccaatcaccacaaccaccctcatcccacagatgggctccagatgtcactgtgtggaggtcctctatagattttcagatcacattcagtcactggaggccaagacactccctgtcactctctgcccaaccctccattcctaacctcacctctcccccacggccaacctaggtccattagccatgctgagcttgaggataagaggactagtttccattgctggtccatagtttccaccccagaagcctccatgccccatactggttaaaaagttattgcagaagaggtttgccagaggtaaaccaggtcttccagagtataccagaaaggactgcatgttgtctgtttgagtgggggacttcatgcccaattttcacagggcaaagcatctcctggtgtcttgtgtggcaaacagctttgatacttgcccatgtcccatggtgtccaggagacttttcattaaatgaggtgaccactgcccctttagggcgtgagccaggcatctgagatggagattacgcattctgtgtctctgcctgacacaacatttctgttttcctgatggcttatctgatgccattaaagtctctacctgtaaatagtcagtagacattgggtatgaaagacccaaacaatatttggctgaactgttcgttgccacagagtattattagattagattggatcttagatattgaagaatttttactcccttacttttgcaaacctggaaaaaaaattgatgctatctgctctctagaactaatactttatggtcttatcctcttttctcctctctctcactgtgtctgtgtctctatctctgtctttctctgtcttcctctgtctctctcacctcttttttctcttctctcctctaaaggaaggcattgactcttccagagccactaagagtcgaggtttttttttgttgttgtttctgtttgttttgttttgtttttgagaaagggtctcagtctgtcacccaggttggagtgcagtggcacaatcagagctcactgcacccttgacctcccgggctcatgctttcctcacacttcagcccctggagtagctgggactacaggtgttcgtcaccacgcccagatagttttttttgtatttttactagagacagggtttcgccatgtttcccaggctggtctggaactcctgggctcaagcagttcacccaccgtggcctcccaaagtgctgggattacaagcgtgagcaccaccaccgtcccccacccccagccaagagttgtttttatcatgtccttagtcttgttggttgctgccttgtccctttacctgttgttcctcttcaatcattgcaacagtgacactccccttagctgggcatcaaacacagacagaagcatattcaattccaggagtctccactgtctctcatctgaatttaagctggacacctcgcttgtgaatgcagaggggccagcatcccactcccgccttggcgcaatgcaaccggcacctttgagggggcagattgtattgtgccttgtcaggcccaccacggcttttgttttcctgcgcatttgaataatacatctgattaccatggcaaatgttgcggcatatgcaagcttggacctcctgcctaattagctgttgataacagggccccctgccctttcccctctccgcagccctcagggacatgacagttcttttatctttcttcaaaattgacttgctctcccgaccctccagtagttcctgttttgtctgtttacctctcctgcattttgcaagactgttaattttccgtggcacctcctatctggttgtaattaacacatcgcacactgaagaaatagttctgctttttccagatgcctaatggaggcatgtccttttttttcttttctccactaattataccactgtattttagcaacctgcattgacctaaaaggatctgttttctttctttcttcctttttttttttttttttttaattgttttggttggaagaataagtatggttttagaacccagtttgggcagaaactgggaagagaatgaaatcattagtgatatatgttgtcactgtttcttttcatagcctttaaagtaacaaatgagggtacatttgttgtcagccttcctgttcagcgtttgacaactctttgttagatgtgggtaacgtttgctttggatatatgctctctctccagtctaaatattctgccgtggtaattatacagatggggcacatgacctattccgtagagtgtggaaattctcagcagattgtaaatagcctctcgtcctattagattttaaggaagctaagcccttgcctcccaaacatgagacatggaatctgtttatcatcttatgcttaggcttaagatttaagctgtaatgaatactggttcaaagagattgaggtataagaaggaggttggtagttacagcaataaaaacaggagcaaaaagagcagcttttgtgaaggactccggctggaataatgatgatagaattgtctaaatcgatacatctcttgtcagactcatgtctgatgtttgaatcaaccaggccttttctgcaagagctttcctcaagaatattgaattatttattatttgtatctttttttttctttccctttctgatgattttttttccttctgacttagtgaaatttgtttttcatgctgccaggttgaatgttgtctactctttgataaatagcagtaattgggcatatagcaggggtcatgtacaaatgtatgacttcaattacatctagagcatttttttctttatattgatcttttttttttcttataagatctgttctctatagcctgtggtactgagtactttaaagaattattctttgtccatgtatgtcagcatgcactttcaaatctatatatcttttaaaatatatatatatatacacacatatatatacatatatatatatacacatatatatatacacacacacacacacacacacatatatatatatatgtagtcctgcgctttcctgaggctgtacagacgtgggaggcgaaattgtgacgcctccacttgatgaaccatacctgactcttttgctcatcttgcagtcttgtggcggtgtcatttctacggttggcttttcttgctacaggttgggccaaggtggagaaggcactggtattgaccaggaaagttgtatgtaatagaaattgtagagcacagtaggagaagaaaagtgaaatgaagtagacatgggaggcagaaagacaaagagagagagaacaacctatgttgtaattgaagcttaagaaaataccatccttggacactttcttgtttctgattttatctaagtatcttctggttgattcttaaactgcatgtatttatggcacatgtatttgccagtttaatggacacttttccatctaggactgtttatattcaggcacccatacgtacacatatttccaagggtaaataaacaccagcctgaatgtttggtgagattagctttggcaatagtgacatttcccaggcacagccaggttttctaaggcaggaatctgaggtctgatgatattactgctctgagcgtacctaacctacagtttgaggaaataaaaggtaggttggaagactgccgaggcccccagttggctgctgcttccagagactgcaggcttactcagtgcttactgtcccatttccactggcctggagatggcctttgccaaagggcagtcatagaaataacaactccacatcattccttgtttggttctgcgtttctgtaccatggcatcgtgctgtcgtcagcagttttctgacatgcaaaataatgatggggcactgaattatattttgtaagggcatgcaaatagagagtgttcatttcttcagcctttttgaaggagaagtgagcccttaaaagtcattttcgggtaggaagtgtacacacattattttatgtcatgcccagtccctaaagccatatctgttccatatttttcagagggagaaaatagaataaaaaccctcagaggctctgagtgataaaggaaacacagtctcagttattatgctgtaggagatgaagctgggacttaaatagacaaagagaaatggagttggctttggtcgagcctgtgattctgggccacatcgtatttctgtgtgtatgtttgtgtacgtgtgcgtgtgtgtgcgtgtgcttgtgcgagtgagaaacacttggatagaactgcctctcccaccagtaggctgttaggcacggcactcagaaacagccctattgttttagatttcctttcatatcatgtaggcgtctataccatgccacccacacaggagagcaagtgagctgtgaaatatattcattgttagagtactggggaaatggcggcaagcaatcggaggtaataatgtccgacaggcaagggaggctgccaacattacctgcattatttcggttgcctttttcattataggttcgggaaataggcagcaattcgattatggcatgatttggggtggaattgcttgcactccgtgaccccgtcactgggggatcaaatgagaagtcaaatcaaataaagttcatagtgcattaaccggatggagcagtgccttacccactcagcacgatttttcatcttccaggggtttgtgactgcagcctagatatctctgcaccttaaggcatggggaggattggctgagatgtataggagtgaggagaggcggccaatagtgtgcaaacccctcccctcccatgtgtagcgccgagtttctctgcagcttgagcaaagcagtgtgattaataacaaggaggaaacctgcttgttggattattaatttcccatcccctttgccttattttttttctttgccatattcctgatgctttttcttctgcctcttttctttttgccatttgctaaagcctctccacccctccttttccctcctgtggcccacacttttgcccatggagatatccactagtcctttacactgacacctggccacccaacctcgtgccggctggcttcacacctggggtgagtttatctcttcccttcggggattctgtctctgaaactaggagagagagaatgagggagaaagagagagagagagagagagagagagagagagagagaatatgaatatgggtccagtggtgttggagccctgctgtattttaatcatagacttggccttcttttaggagtgacccaaaaagcaagaccagttcgtggggtacctgtatccaaccccatttcagctgctgtgtggaaaagtaggatttctcatagttaactgattaggtattttctcaccagttctaaacacaaagagtgcatcttgcaaaaatataaaaagttgtggggggtgggggtgcaggcaggggagataatgactggtaattgcaagctgtcatactaaaagatatttggggtgcaagagttacttctgccagcagaatggtagaatggaggaagggggagatttggaaggctttggggtagcttgtgaggggaggtactttgcattaaaacttctgtcaccatctgtactttcgatttcacagtcctaccctcacactactggaaaggagagtttcatactgactgtgggcacaggggagtggtttgcaattgcagcttgtgctgtttatatggtgcatgtgatttggggaccttctgggttctgattcgctgacctgcccagaggaggaggctgggccactttcttttccacattatgtattgcacacctctgttctgtgtctctcctcacctgctttgaaggatttctttccctctctgcaaatctctcccctcccgtaaatcagcatgattaaatagcagaagggtggaggtggcgccatgcattatgcacatgagctgtctttaccagcctgtccatatgtctgaaggaaaccttgtgttttaatcccaagaagtcaccttttttgaagattaccttgaagcatccaaaagctaataggatggagaactaaaggcatttgacattaattgttctgtctatttatataacttaagcacaaggcagcgaaaatcttccaagctgattatttctttggtttattctgagtctcttttttaagcattcagagcttcttaagtaatgaatttttaggaaaaagagccatgcaatgataaagtgactccagtagcagatttttgtcattttttttaaaagaagtgctcaaatagggcagccatgaattttatttgtgtaatttacacttgaatatgaatatatatatatacatatatatgggggtgggggtctagctctgtcacccaggctggagtgcagtgatgcaatcttttctgactgcaacctctgcatcccaggttcaagcgatgctcctgcctcagcctcccgagtagctgggaatacagaagggcatcatcacacccagctactttttgtatttttagtagagacagggttgcgccacgttggccaggcaggtcttgaactcctggcctcatgtgatccacccacctcggcttccaaaagtgccgggattacaggtgtgaaccacctcacctggccatacgcttgaatatgttttattaaatatgagattactggtaaggacttgatgtttacatcatagctgttcacaaggtacataatgcatttattttgtttcttatgtagtgcccaggataagaaggaaatgaaagaacctatggaaggggatacaatttcagctttgacagtttgggatcatagtattatcctaaaagcaagcaaacaaacaaacaaacagtgccagctgaaacaatcacataatcacctttctagttattttttcttcaggttctgggtctccctctggaaataacaggtgttattttgactgaatgaccccctactgaggtaaaatttggagcagaatataatacaaattatattccaaaggtgataagatacttgggagtttgagcaccaagaagaatgttatcttagagatggtatgagtataatacaagttggcattattattattttgacataaaagggggaaattattgtaaatctcagtgtgttgtctgtatcaagtactcattttttaaaatatgttttttttccagggaaaggcttatactgttgggaaataatttcttttagacatttagagaaaaaaatgtgaaaattatgttttgaagtgcatttttgctgtagaatgctagaagtccattgttgtttaatgcttcatttacagcatgcggatttacaacacactgaatgagagaagtggggtttaattttttcactatgacttcttataaacccgcaaggggtctatttgatgagtaatagttgagttgacttttacctacgagttaccttctccacgtcttcattgcttcatttttccctcaaccggatcatgtaatagaaaacttcctcaaaacctgttcctacttgagaaatttcaaaggatggaaacccttctttgaaggacttaaaattacatttatatcaggatgaatcatgtttcgactttaaatatcaccttatttctggcggtctcttttgtttccaagtggcaaatgttccttctgaaattacatagtttcctcttgctcattctgtttctaaacttctctggataaatgtgtgaaaataaatgaaattgttaagccctgagaataagcttggaaaatagaagttatcctacctgggcaaaagctccaaacattctaggggggatagagacccctcctccctcttttaacaaatcctcccttgaactggggagagaaaggatcgccttccaggattttttttccctgacgtgtaacagttcttaaaatactgccttgttaatttgtttctattttacatgagcattatacaaacagtgataaacgaaatgtatcattttttccccataaagcctcctcccagattctcctcagtgtttacagaaatgtgctgtatccatgagctcagatcaattgtttatacacattggtgttcatttgttcaaggcggcatctgggcctcggatgtcgggagagacccactgaggcaaagcactattaatagaaaggcttatctcgtttaagggagtaatcattttaatatactcaggaaaaagccagcgtgcaggctcttggcccacccttgcctaggcagggtctacaccttccagaagcaaacacagccgaaaagagctcttaaagaagtgattacagagtcatgattgctctacaaattgagtcttttttctgcttgacagtgatcctggcatcgtctccccgcttaatccttactagcaatttgcctatagttgcagctaacaagaggtgattagaggggagttgccagtcaccacttaacacccagctctgggggcaccatgggcacaggctgccgaattgggcctgttttcttattaactccccacctctgaatgcattagcccagctcttagctaatgatagttttcaagcaacagcgtgagttcctgagcagcatggtgatctgactctccagcatgcagctaggaaaattaggaaggagagggagaaagcatgttgttcttcaaaccaaatagatgcgccaagggagaggatctcccccaataaaattaggcgcacgctgtgctgcgtggctgtcttggtcttggaggttgtgggttgacacaagaaggggacatgatgcgttgcatattttatctgtcctgtggaaggtcctgagaataccaacagcagtggatcttgggttagaagctagagtgaagtggtctgcagacaggagactacacctacaggggtgtaagcagagaggcaaggcaggctgtctgggggacaggtccttggttatcatacatgagggtgcatcagcattcctgcacggcttgttaaaacctctgagtctgtggcagatacacaccatggaatactatgcagccataaaaaaggatgagttcatgtcctttgtagggacatggatgaagctggaaaccatcattctcagcaaactattgaaaggacagaaaaccaaacactgcgtgttctcactcataggtgggaactgaacaatgagaacacttggacacaaggtggggaacatcgtgtgaccggggcctgtcatgcagtggggggagcggagagggatagcattaggagaaatacctaatgtaaatgacgagttaatgggtgcagcacaccaacatggcacatgtatacatatgtaacaaacctgcatgttgtgcacatgtaccctagaacttaaagtataataaaaattaataaaataaaataaaacctcgagtttctgattctgtaggatgtaggacggggccaagtaatttgcattctaacaaatttccaagagatgctgatgctgctggtctgagaacccccaagtttgagagcccctgctgaagttggacaggcttggttttgcaaaaatgcgaaacgtaccaaatgtaccctccggtgacttgcttaacaactgtgtgtagctctcccagtgcagaagaaaatccccagtctctaaccaacttctgagacattaggccatcctttcccctccaattttaccttcccttgcccaagctaatttaactctttctttcttttcttttctttttcttcttctttttatttttttttatttttatttatttattttttttgagatggagtctctctctgtttcccaggctagagtgcatggagtgcaatggctggatctcacctcactgcaaactccacctcccgggttctagtgattcttgtgcctcagcctcccgagtagctgggattacaggcatgtgctaccacgcccagttagttttcatatttttagtagagatggggtttgaacatgtttcccagcttggtctcaaacccctgacctcagatgatctgcctgccttggcctcctaaagtgctcagccaccatgcacagtcttaatttagctgtttcttgaacatactccgtgcccccatatcagatatctttttacattccaagaatgtttctccctcctatttgctcatcctaaaagttcttacctgtcttttaagttgtggctcaagtattgcctcctccaggaggccccagctgcatttgtcatttcctccaaatctgaactccttatatgctgttatgtgatggatgtatcacgttgcatgatagtgcttacgtatcttttcccctgaagtcaggaatcccttttattcatttagtttctccaacacctagcattgctattggcatatcgtcactgcagtcaactttttttgttgaataagttttgtatgagatatatttgacctatgagaattaatatctttttttttttttttttttttgagacggagttttgctctgttgctcaggctggagtgcaatggcatgatctcggttcactgcaacttttgcctcctgggttctagtgattctcctgcctcagccccctgagtagctgggattacaggcatccactaccactcctggctattttattattattattattattattattattattattattattattatttgtagttttagtagagacagggttttgccatgttggccaggctggtatcaaactcctgacctcaggtgatccacctgccttggcctcccatagtgctgggattacaggtgtgagtcactgcacctgaccagagaattaatatctaataagcgaagaccaaacattggagtcagacagcttacatttgagtgttcacacaatgatatatgtggatttttctttctttctcttttattttggctttgagggcaattcacttcccctctctgagactcagtcttactcatctttataatgggaataatgataatgataacagtagtagaagtagcagcagcagcaacagtagtagtgagtgacactactcacatctgcacatgtaggtcgtaaagtacaacacagtacaatgcctggcgctctgcaaagaaaaaaagtgtatcaacagacaggaggatttctattgttgtccttgattctactgtgagacgtccacactggtggaaaggtgacctgtcttgtggaaatgaatgtgtggaagtggagaggacccgactccagagctggtgggaaatcgagcggcataaggcttttctgacatctcctgatgtgaacactgtgaatataatcttgtgaaccagagcaagtggaggggacatctactggacagaggcacagcaacatcctctctctggtcaccccttccctgctcacccatccccggccatgctggcttcttcctcctgctgaagcactcagggatctcaaggacttggcacaagccatcctgcctctccttccctcacccccttttcattcatcagctgttgattttggtgtcaccgtcctctgagaagccttccctggctagcccatcaaaagtgatcctgcccagccaacttttattctctctgccagcacactgtacttttccttcatcacattcatagctgtctgcaatgatattaccttgaattttagtttacagtaagcttcaagagaacaggaagccacctattttgtcctctcatacacccagagcctagaatctagaggaggtgagcagaaaatagtcgtcaggtggatgaatacaggatgggaggaactgataaaaactgccatataaccatcatgggacatggcaaaggtagataatatatcttttcccttgggaatttacaatttttattgggaaaagtgcatgggtagagtatcactcagatatttctttctgtgcttccatagaccctattatttccctaacagcaaactctgcctttccattcttcattactccaactaataattattgagatatactatgtattgcacactcttctagaagctgcagaatgtatcagtaaacaaaatacacaaaaatctctgcctttgtgggacttgtgacagtgttgcattgacctacttactttctccctgcaatcattgagtttctcttggtctagggccatttgtcatcatagtttttccccagctcctaacatgattcttcacagagagtacatgctcaaaacaaattggcggaatgaattgatttttaaaaacttgttctactttcttgccactaagtctataatccaaccaaatgagcttatcattaatctagcacatttaaatatttttggataaataatgttccattggcccacagtaactattccagcctcatgtcttcactcatagccattccctatttcgaaaattatttattgttttgttgtggtggtggtttatgcaattcccaaaagcaaagctgcagcatcttactgctgataatattttgaaacaacttccttctttgaattaaaaatggtacccacctaggctgggcgcagtggctcatgcctgtaatcccagcacttcgggaggctgaggcaggcagatcacaaggtgaggaaatcaagaccatcctggctaacaaggtgaaaccccgtctttactaaaaatacaaaaaaattagccagccgtggtggcacgtgcctgtagtcccagctactcgagaggctgaggcagaagaattg[136 bp omitted]atggcatggaatagtacattggacttcaagttcagtggccagggtccacacaggaagcctggtcgtcttgctacctggatggccaagtgcaagtcacttaactttttataatctaagcatccttattcataggaagggggcttggttatcatgaatattaaataacgtgtatgatgtgactggaaaagaaccagacgtagggatatgccaaagaatgtttgtttgctagtttcttagactcagaaaaatagaagcacgtgtacttgaatctatgttgtatggtagttttgctttcacaatcatcaaacaggagtctaagcccaccctggtcctctggctttctactaaggcacaggcagcaccagcttttccataacaacaacctcaaacccaaactgactaattatctactgtgtgccatgcactgtgctagtgttttgcgtgattatctcgtttgattccttaccttaactctaacaagggatcctattttttacatgtcttttattattattgttgttgttattttgagtaggactctcactgtgttggccaggctggagggcagtggtgcaatcatagagctcactgcagcctcaagcttgtgggctcaaggaattctcctgcctcagcctcctaagtagctggggctacaggtctgcaccaacatgcgcagttaattttttaattttgtgtgtgtgtgtgtgtgtgtagatgggttcttactgtgttgcccagactggtctcaagctcctgaactcaagtgatccttccactttggcctcccaaagtgtgggattatgggcgtgagccaccgcgccactgtgcccggcttaatatgtcttttatttttaaaaaatgctggtaaaatacacgtaacataaaatgtgtcatcggtgatatttaatgcaaccgccatcactgtccagtttcagaacatttttattacttcaaaaggaaccccatatccattaagctgtccctctccattctgtcctctccttagcctctggcaattgctacagaacaaagacatggagaggttaagtggcctgctttagacccacattactgagtggcaaaactagtatttgaggctgggaagtctgctaccctagtgcagaacacttaactgttaaggtaattagctccccattagaaagacctttcccccaccatccagttcacaggaggcaggggcttgtttctagctaacacaaaagatgattttctctgaggcctcattacgggatgccaagcattcccaccagtgggcagcctgtggcacctagaaggtccgctccttccacttgctttccttacacccagcccagtgggaaggagggtgtcacttcagcagtgggggcagatgggtcttcagatcccacaggatgcccccacactgtgctggtcatccaactcattgtcaggtcagcaggggtgcctgctggcacccagagcttttgcctggggcggaaatgtggctgtctgacttttcttagttttcatccttgtcttaaaggtaggatgagtctcccaaggtgggatagaatgctgggagagaagtgaactttgggattttggtaaaattctctgcacaaataactcccagagagaagggtaatctgctaccccactcatctttactctttgaaaaatttaggatcccaatcccagaagagaagctttttgtgaattctcctaatgcaatcgttgtgcttactgaggctgcttggagagactgtcactcaggttgcattgcaccttaaagacataggatttcttgtcttaacaacaggtatgcacaaacattttttttataaaggaccagagagtaacacttttaagctttgtgggccatctggtctctgtcacaactactcagctctgccattttagtgtgaaagcagtcacagacaatacataaacacatgggggtaactgtgttctaataaaactttatttaccaaaacagatggttggctgaatctggcctatgggccatagtttgagagccctgtcctagactccagctgatggccttttctgtgatgtgtggaatctcccccaagcattctgttgattcctggaactatggctcctttgctctctctgctgcttcccagcttgtgaatttgcattcatggtcatctctgttttcaggccatcataacacagaatcaacagccttatggtgttgccccagaggattcaatgtgtcaagtggcattttcgaactgtgtagaagacttctctgcagcttctgtggagggaaacagggaaggaggtttatatcttgtagcccccagcaaatgccacgcaaaattcccgcataatcttgttttcccaggattctttctcagcagccttggaagtgggatagttggggttggtgtgcccattgaattcccccaaccaagtactcaaacttgctgatcctcccttctttccttctgggacttcttaggaggaagtctataaaatctcttgtctttaatatgcaaaaaggttttcttgcctcttctagtaaaaacacatagtgggcagagacggtgagtaagggtccagttctaattcaaaccctaagctcttagtttgcattctccacaataaaggcagtagtctctctaaaggaaattctcactgatactttttctcctccccacgtcatcatagagacatggcatggcctttgttctaaggaacttcaagtctaataggggataatgaatgttccatgtagagcagatacaaaacagtggactgagtccataatgctgtgttggagtacagacaaatgcgcggtgaaatcttgctgaaagactgcatggaggaggaggcatctgaattgagtcttaaggggttcatgtcacacaggtgaagcacactgacttcacgtgtttgaagagttgtctgggagataggttaccaatttagtttctacagtatcagagatagaaaaattcatccatcccttctaccatccttctgtccatccatctgttcatccacccatccacccaaccacccatccatctaattatccagtcatctaactatccatccagccagccagccagacagctagccagccagcctttctaaaaatacttatttaacacctgtgtgtgccatggagtaagccaaatgacagggagagaaaggtaaatgaggccatctccaaaggagttcagagaaaggtggtagataggtatgttagacaattcatttataagctgaatagttaagtgcaattttgagtatttgtgagaacgatgagagggaacagttaatactattggaaactgctcttggaggagtcaagcctgaatgatcagaaagacactaaaagatgtaaagcaggtaaaaaggaagaaagatcagggctgattttggagagcacggagtaaagtttcataaaccaggtaagagcttaggagatgacagacatgtggtggtataagagatgaaggaggggcggggcgcggtggctcacggctataatccccgcattttgggacgccaaggcaggcagatcacgacttcagaagatcgagaccatcctggctaacacggtgaaaccccgtctctactaaaaatacaaaaaaattagctgggcacagtggcgggcgccagtagtcccagctactctgaaggctgaggcaggagaatggcatcaacccgggaggcggagcttgcagtgagccgagatagcaccactgcactccagcccgggcgacagagcaagactctgtctcgttaaaataaataaataaataaaaataaaaataaaaaaaatcatcaggagatgaggagatggactgggaaataagacagaggcccaaacactaagaccaccatgacctactggactgcatcctttagaagccctaaggggatcctaaagtttagaattctaaataaacattttattttagaatacttttacatttacagaaaagttgtaaagacagtccagagagttcccatctacccagcgtctagtttgccctcttgttaacattttttttttttttctttcctgagattgagcctcgctggatcagccaggctggagtgcagtggtgtgatctctgctcactgcaacctctgcctcccagactcaagtgattctctagcctcagcctcctgggtagatgggattacagacatgcaccaccacactgggctaatttttgtatttttagtagagatggggtttcaccgtgttggtgaggccggtcttgaactgttgaccttcagtgatccgcctgccttggcctcccaaagtgctgtcttgttcacattttgcatttatcatattttacatatggtacgtttatcacaactaatgaaccaatattgatacattattgttaactaatgtctacattttattcagatttccttagtttttacctcgttcttttctgttccaggatgtcacattacaattaattgccatgtcttcttctccccttctggtctgtgactgtttcttagactctgcttgtatttaacgaccttgtcttttttggagtactaagcaggtgttttgtagtgtgtccctccactgaggagtttgtctgatggtgagactggagttatgggttacggagaggaagaccacagagacagcgtgccatttgtatcacaccatgtcagtggtacatattatgaaaatgacttatcgctgttgatgttcaccttggtcatctggctgaggcagtgcctgtctcatttttcctctctttgcatactgtgctctttggaaggaaatcactatgagcagttgacacttacgggtgaggtgtttgttaggcttcacctccttgaagcagcagcatctacatccatgaggcttttcagcaggacctgggtaaaggaccatcaggtggaaaatgcaagatgaactattgcaagccacattgaaggagaatttggctcactaccaggaacattgcctgcccccgaagctatttagctgtaggttttggccttcaggtgggcttagttgcagggctaaataattttctttaaagagcttcatcatccaggcaaacatcacagccacagtgccagatcctgtgtcaaagaaattaaaggctcattcctccatgcactaagttgtgtcataactgtaggagttggcctgctggggtatgtgtgtgtgtgttttcccatggaaatgaccaaagcaggcagcacttgttgaagtacgtcaacattactgcagcacgtcattccttttatgacatagcgacctcttttcttttctctgcgctgtgatcttcagttaatttttagggagggtggggcatgaaagctccctgaacatcgtgagaatttctttccacagatgcaaacaactctgttatggagagtgtaactcaagatagcctttttggaggacagattggaagtacatttccagttctcacattcctctcttttgaccgaggaatttatattttttcagtagaagtcattctattcttattgtttttgtttttatttttctatttgacaatgaatcgtgagcatctttcctatgggtggatgtttatgttatttccggttggttttcccatcctctttcattgtatgccaaattactgtggtaggcaaacttggacaaacgtgtttgaacacatatagtgcgtgtcatatattttgtaataactggaatttcctgttcaaaggttggggatgtgtgaaatttggacagtgtccatcagatcactgtcaaacacaggtggagacatgtgtcttcacaacccagtgcaacagcatggcgttatgcctcatccatccaacaactctagggggcaggcataagtagtcccattttaaagatgcataaactgaggctccatgaggttaaaggattggcgctgggttaactctttctttgctatcaggcatttgcggaggatcactcaggaacctttgaggatgagatgtcctgagctccagctcctggtgtctgacctcccatctcagtgaaatagctagaaaattatttggtctccttgctgagattttcttaacatattttaaaatctcagcctggtgcagtggctcatacctgcaatcccagcactttgggagaccaaggcaggcggatcatcctaagttaggagtttgagaccagcctggcaaatatggcgaagccccatcactactaaaaatacaaaaaaataaataaataaataaaaatagctggtcatggtgatacgcgcctgtaatccgagctactcaggaagctgaggtaggagaatctcttaaacccaggaggtggagattgcagtaagccaagatcacaccactgcactccagcctgggtgacagagcgagactctgtctcaaaaaatctcctgacaccagaaagccacagagcagaagcatcacagggctctctgatttgccataggatcgtttaatctgttttatgatactgtgctagtagaattttccaagttcacaatcacaaacaaacatactatcctcaactgtgctagaattaaattatctttgccccccccccctttctgttatattaaattagtatccttcttctccaaacaggcagctcccactttgagggtgggggaggagtacttgtccatcaaacatggggaaaatgactcctacttccatcgcacagtgaatcataggctctcccatgtcagattctgtggaaaggatgttaatagagacaaaaggacactgttggcgcgttattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaagtcagaaaaaaaaaatgaatatagggtcatattagacaaattgcttaaaaaaaaaaaaagcacaccgcgatcatcaatttaaattcttttaaaatgtgctaggtctttgaagcttttaggatgcactttagaagtccacgtggaataatccctgcatgtcagtgcgacagttgatgtgcgtctcattgtatttaaaattatagttctgagatgggacttgctccgcgatgcttgtctgacatcagctattaaaatacaagtaaatcttggcaggtgggaatttaaaaaagaaaagattatataagaaaaatcagaatggttaatgttaatttactaaccagggtacagtggctacagagagttcttcatgtcctctctctattaagatgctgatgcgagaaacaccttatgtttgccagggatggggatggagattgtaaagtggatgtgagggggtaaagagtgctactttggatgtcagtccatggtttgggtcctctggggccacggtgagcatgatggtgagacaggttcattttattaaattcagattagccgttttgccctgtcctgggagggcagaagaaggtaatcaaggagagatggcgggacaataactgctctggggatcagactggaacatccacggactccagccttcctttagaagggcgtaattcgtcctcacagactcctcactcatttgtaaacctctctgaatcccaaacttgtgtgcgtgtctgcatttagccattgaaaatataatcaggctaatgcattctcttactgaattttaaaccagcccattaaaactcctttaacgtgctaaagtcggcttcagagagggtttccatttcatctttattgagctgaggctatggttcattctccctttgcaccacagtgagcgcctgtcaataattcaatagcgtagccttgatgggcccaggcccaacctagactttcaaccacgccaagcagcttgtcaaagcctgatgctctgtcaatggctgagtgatctatactgcatgaatcccccccttcagctcttgatgtgtccctgggaataaaaagaaagccatttcagaagtcagcccagtgagaagcacctgtatgtagagaatctttaatgagggcaggtcgcgctgtggtggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgcaggaggccttgaactcagaaaatccagtgcaaggagcaaaacatctgaatcatatgatcatgccccagtggctcttcttcaggtgccagtgacggtgatttgaaccttcatgtccctcttttcatggaacgtcatgagtctgtactggctaaagagtgctgtgaaaggcagattaaaaaaaaaaaaaaatccagcctcacctttctttctgggtggaggaaaaggcatccattcactttaagaagaaaacaaatcatttgtattcttcttgtctggacacaatttttaacccagaattatccacctagttcctcccatctccaggccttgtaagtcgataggagatttgcaaatatctcccttaaagaaaggcaacgaggagagcatttaatccatgctttaaatgcaaaatgtcttgagtcccaacgctgctcagtttttcctgaagataaattttagctggattaaataactgttttaaaggcactattcatgcaagtgctgtctcatttgtgactgtatctgcattgctaatggatgtgtcttttcctcatgcatattctttcctgagcatctaccgccaaatttacagattgcttgcttgtcaaattgggatggggtttgaggaagaggtgacaatgatctaggtggaaaagagaagtgccagtgtgttcaaagctaatagaaaattgttgctttgtattagcagtcaaggctccaggtttcctgaaccacaaaacaaccaaatcttttctttcttttttttttttttttttttgagacagggtctcattctgtcactcaggctgcagtgcagtggtgagatcacagctcacagcagcctccatctcccgggttcaggtgatcctcccacctcagcccctcaagttgctggggttttgccgtgtcgcctaggctggtctcgaactcctgggctcaagagacctgcctgcctcagcctcccaaactgctaggattacagatgtgagacactgtgtctggccccaaatgttttatggtaacataaattcatgccactgtggcctgctggtcttcccaattaaacagcagagagtttgttatcccagccacagcatattagggtggagccaggtaggtatgtgaactaacactgtgaaaaaacaagattgtttttaaggtaagctttcgaggagggggaaaggaggtagaaaatgaatatggtgatttcagagaagaaaatctctcccaagcctatgtccctttgtatgtccacaaccccagttaatgatgggtatggcttatgaaggcactgagagcccaaggaatgtggccagcattaggcggcatttgagctgggtcagtgaatcctcaggcgtataggcaattaggacttagagatcctgttgtgattttcatacttttaatctggagagttgcttaatgaatttattaattcatttatttttagcctcacaggttttgctccaagactcaggtgaatgagtaacacagtactgataaagttgagcttttctgtttagggctggggaggagggaagaaggaaaggaaatgaaacccagggctttgcatcttcctcttcaacttcatcccttcctctctattcctcacatttagcagccctcaagggggctacaaggaatttttcagggtccagcgtggcctaatatgccaacttctgatatagtacagctcaattagcctggcatggttgtgcacaaatgtagtcctagctgctttggaggcagaggtgagaggatcagttaagcccgcccagagtttgacgttgcgctgagctaggatcatgccactgtgcttcagcatgggtgacagaggacccatttcttaaaaaccaaagaaaaaaaaaagacagctgttattttcctaagatatcctctttaaagagaaatggaacaagtgacctgccttcctctatatgaggtggggctcacaccagggttctcctgctcaccattggcccaggaaactcaggaaattaatgctgcatgcgcatgacttggcgattcgacctctgaaagctctgcaaggctaggaatttatgctttaagaacaatcagcatcaaaggccttggcagtggtggagctgttagcatattagttccatttgagatggtgaaatgccttggaaactaaaaaccctacctaataaagtttattttcaaaggattagaggtagagttttgctctgagagatgatgttgcctaagcctcccattacagaagagcagagatgggactctagggattcatggatgtgccagcgtcactgggtagtggtaaaaactaaaactggtatctgtttctctcctactataatatctttttcacgtcagggcttgtaaacctgaaatctacactttagtttcacccatatgatttgtttttgcttttttcccccctgttattagctgccaacatttagatatgtaaagattacatttaaaatcgaaatttttggcttcttgcaaaaaaatcagacgatctggcatattgagcaacatccgcacacttcacccaccagctggagctctgtagcacctgcacacctcagtgtggagatgagctttccactcccaggtcaacacagaccctcttactcaggactcaccttcgcccagcctgcttcacgatccactggctgtcacaggcatttgcctccgtagtgctctcctcccacccttccacaaataaacgtgcccagagatgctggcagcctggaagctttgcatctgcattggggctgcccgttctttgctgccatgcctgaagatttcagtagctctttgtcagcacaaatgagcttttcccctagttcatggggagaatgggatcctggcacatagcagaaaacatctggtaatgaatccattaggcaggctgttgctcagcctccaggtgcccaggggtctgagtgctgggctgaacatgatgcatgaacgggaccccagagattttaccttttggccttcgttctgccagagctccggcttggtcctaaggggtctcctgactactccaatgccaggtgttctccccagccatccccaagcgagaagctggccagccttctggattccctcctctgccttctccagcagcagtccgtctcccagcacagccttccttaggcacacaaaggagaagacagagatcatttttggcagacgtaaggagcagcatttgtcgaactctgggccctgcaactctgtgaacagacctgcatgctgtacaaaattattagaagccctgtgtctcagggctcaaggaggttgggcagggaggtgagagtgaataaaaatgaggaggccgcaaactgcttttgcccaagggctggttttaatgagcttgtccctaatgagttgtccctgcaactagcttcaggcctaaacagatgaggcagggattctgctaaatttttgataggatttgcactggttttatgagaaagcaagcagtagagagtgcaaagttgggtcatgaatcttttacgagggtggatggttgtccgtcttgtcaaccggaacgagaaagacctggttgctaatagaaaccatggcctcagacgtcgatcgtcacccaccagatcagctaatttggtcagggtggctgggtgatttgttttttttctgattcaggacctggcctatggcccctgagaaggatttatctgaaaactccatcaaggagatgatttgagccattgcctgttcctgactaatgatcttttgtggaactcaagccatattggggatttatacctttctcccatagtgcactgggaaggaaacaccatcaaacactttaattaacatcctttttactttgggcagccccattcgtatcaaaaccacaaaccttacccttcagttgcacgagaacactcttaccaaggataaaatgtgattttcgattcctatggagatgtttctaatgtttctaacacccgtcaattctaggatcgcgtggtacaggagatttcatgtactaccaccttttttttaaatattaaaagctgccaacaaatgcatttctccagtttgattcatataccaaaaggcaattttcttggtggcttagaaggttacagaaaatgcttgatcagcagcctttactgtgctgagtgaattcctaccccatccccctcctgtctcacacactctctttcacattaatcatgtaattgatttaataagctctggcttcaagagctccccctcccctctttctttgccccctccccctctcttataagatttcagttcagcgtttgactggtaggctaagaaccttgaatcctgccagatatgaacccaacaaccttgttggtgtaataagtatcctcatcttatatttctgtggctccttgaaacataatttttaagccatttcattaatagagttcaatgtaataatgtaaaaaagtgcagcgtatttctatatatgtctgtagatgtagacttctgtatatatctacttttcacaaacttgaaatcatttcacatgtgttgtcttattcaaacctctctaaaccgaaaactttgagagttgcccagaagagatccgttgctcctattttatacattacaaaaccgaagtacagacagatgaactattttaagaccttgaggctaattagggatgcacgtggcgtgaaaattttgggcgtctgaacttcctacaatagggcactactgattctgtattcctttgttgcctgaggcattcctttctctgggagaaaccaaagctgtacatatttatcttcaagagaaacttccactttgcctatgaagaaatagttagaattgttttctgtggttgcctcaagttagaggtgctaatatacatggaagttaaacaagaccacacatgtgcaaaactcttgatgaatcacgttattatactaaaccaacgttatactaaaccaacattagctagggttattagttcagattatagttatgcaggtcttccgtgttaagtctcatgtaaatatcttctggagcttacatgtgtagttatctatgttctaacctgtttcctaatgggtcatccagaaaacgtgggtgtggtctggctggaacagagtccctaggattgtgtcagagtcattgtcgtaagatatacctattcagaagttagttatctagatgttagagtctagagatggggcttcaatgagggatgtcaatggcagtatggggaaaagagaacagagttgaagactgaacagcctagggggagagcagaaagcaaaggcagctttataaataataaagatgttctgcaaaaattcctctgactgggttctgattggcttgggtagcctttttttttgagacagggttttgctgtgtctcccaagctagactgcagtggcatgatcctagctcactgcagcctcaacctcccaggctcaagtgatccttctacctttgtctcccaagtagctgtaccataggtgcacaccaccacacctggctaatttttacattatttgtagaggtgagggctccctacgttgcccaggctggtcctgaacccctgggctcaagtgatcctcccacctcagccttccaaagtgttggggttacaggcataagccaccgtgccccactgacattttactcttaatcctggcctgtatttaaagggtctgggtgaatgcagatagatagacagttactacgcgtaacagcttaccatgaattctaagtctcaacaaatccgtaatcatggtgtgtcatatgaagaacatgttctaactcttattgctgagcctgactttgaagtgtttgtttttttttttcttctttttttcttttgggaataagaaaaagcaacgttcttgactgcccggaaaaatactgtcttgtcagctggggatgcttggtgctgatgaggaatgtggtacagggtggggatagtcccttttaaagggctcagcatgtgcctgggcagttagcaaggattaaacaaaggaaagttggtaatattactgctagtatgagtatgagtaaaatgaacagtggaaagaaattaataataggaaattagtgatactatgtgtttaatatgcatagagcctctgtaatcttagcttctgaacaatagcactccccgctactcctctcttaatctggaggcccatgggtctccagtacccttatgcaccagctccatttgaggaaatgaaagtaggaatcacaatatttgccctggatctgcataactaggacaagcttttgaaagtggaagaggcccataaatgaacttctcaaaatgcacttgatacagcatcaaataggagtgacaggtccataaatcaagggattggggtcatttgattcaaatgtaaattgtcccctgcccagaaaactcattgccatgaaaccctgcacagaatccagagaacattttcttctggtctcttagaaattcaaaatacaagatctacatggtaccacagtttttgttgctgttactgttgttgttgtgtggtttttgttgttgttgtttttgttttgtcttttcacgcgggtgacgtttggagatgcccaaagactgatatcccaaaagtacctaatctacaacaacaaatatttatagaacctttatctcaatatttgctcattgaagtgggttaataaatgtctgttgaatgctctcaattggatggtgagtattttccattttagtttagctgtgaagcttcgctttccctcctatgccttttgttttcttgcctaaagaagcccatttcaagagtcggggatcttctctttctaatctcagcctgcccaacaatttgtagcatggtcttgctacagccgctttgctcccctgctactccatcttgtctgagatctgggttaactgggacttaactccttgtcaaagatgctgtgtgaaatgactaattaacaccagagaaggaaagagcattgtcattgacaaatagggcttttaataaccagcagttctcctggttattaaagttggctcttgagtctccccagacccatgcgaattgacaggaaggaggatattttagttccttctatgattgagttgcttgtcacttgagtttgtaatctcaggagtcactttatccatgttgtcccaggaatgaaaatggtgtgaatctaatttcagaagttgaggagaagtagaacaaggaggccatgattttctagtataactagacaattattttcagcaagttctccctcactgttgtggggtgagtgctcacatttgcctgccgctgagctatgttttaatgaggttggaagaagcaagaaggttgggaagattgatgttaattgcatttctaccatacactaagcagtgagcagatttaggatgactagtgtcctatagttctctttcaagatcagatcaagcttcctgaaccacatgagcctgtcttctctttacaccagcagcctcagtaactccctgttgggcaaccccatagagcaaacaccagaaaccccagaatttttctcttactaaagaagaccctccactgtcaacttaagctcacgttttcctatttctcaagccaaggtaggtctaggtattttttttttttttttttttttttttttttttgagacagtgtctcactctgtcacccaggctgcagtgcaggagtgtgatctcggctcactgcaaactccacctcctgggttcacagcattctcctgtctcagcctcccaagtagctgggactacaggtgcccgccaccacacctggctaatattttgtatttttagtagagaatgggtttcaccatgttagccaggatggtcttgatctcatgaccttgtgatctacccgccttagcctcccaaagtgctgggattacaggcgtgagccactgtcctcggcctcaaggtaggtctgggttttatgagatgtgacacttacagaatttgggagccctccgtaagaaaaacattcacactttgggaggccaaggctggcagattaattgaggtcaggagttcgagaccagcctggccaacatggggaaacccccatctctactaaaaatacaaaaattagccagctgtggtggcacacacctgttatcctagctacttgggaggctgaggcagaagaattgcttgagcctgggagacggaggttgcagtgagctgagatcatgccactgcactccaggctggccaaccgagtgagtctatctcaaaaaaaaaaaaaaaaaaaagagagattccaatgagattcaaaattactagtgcagagttgcagagttaggggtagcataaaaacacattgcctgaagtgatggtctctgaagcctaagcccagtcaccttctcattatccatttctgttcccagttgaaactttgcagtaataaagctgattttataaagtggtcaagagctgtatcccaaacttttccttgcatcttcagctcttcctgtctatgaacctctgcctctgttggcctagtctctcactatcctcttcttttattaagcaattaagtattgattaaaagccaagtctagtgagagctaaatgcatttgttgaaggttataggtcttgttatgggaaagcaggagtggaatgtagttgaattaacctagcctagaacagatttttctgtgtgttctatgaattagctgtatcagcatcaaccccctggaggggaggggccaacaggcatctgcgttaaatatgtacattcctaggtcccttccaaagtactgaatcaggatctctggggttgggatgtagggatttccactctttagaaacacccaccctcctttcttctgaagcatgtgaaagttgtaaaacaactgactaatctaagggccactgaaagctactcttaagatgcagcatttacttgagactcaaaggatgaatggcagctgccaagtgtattaatttcctaccccttccatagcaaattactgcaaacagagcggcttaaaataacagaaacttattctcttagttctggaagttggaagtcgtaaatcaaggtgtaggcaaggtggattccttctgagaactctaaggaaggatgtattagttgattctgatgctgctaataaagacatacctgaaactggaaaatttacaaagaaaaagaggttcagtggcctcacagttccacattgctggggagacctcacaatcatggtggaaggcaaaggaggtgcaaagacacgttttacatggcggcaggcaagagagtgtatgcagggcagcttcccttaataaaaccatcagctctcataagactaactgactatggtgagaacagcatggggaagacccacctctatgattcagttacctccaaccgggtccctcccatgacacatgggaattatgggagctacaatttaagacgagatttggctgggggcacagcataactgtagcaaaggatttgttctttgtttctctcctggctcctggtggctccccagcaatcctgggtgatccttagcttgtggctgcattactccaatctctgcctgcattgtcacacatacattttccttctatgtttgtctgtcttcacctaatcttcttgtaagggcaccagccattggatttagggcccactttaatccggtataatctcatcttaactaaatacatctgcaacaaataaggtcatattccagtgttcttggtagacatttttctttcccctgtttttttttttttttttttgagatggagttttgctcttgttgcccaggctggagtgcaatggcgcgatatcggctcaccacaacctccacctcccgggttcaaacgatttttctgcgtcagtctccggagtagctgggattacaggcatgcaccagcatgcccggctaactttgtatttttagtagagacggggtttctccatgttggtcaggctggtctcgaactcccgacttcaggtgatccacctgccctagcctcccaaagtgctgggattacaggcgtgagccaccatgcccagcctgacatttttcaaataaggtcatattctaaagttctaggtggacatttttaaaataatgtctcattacaaagtcctaggtggacatcttttttggcagggggacactcttcaacccaccatgccaagtgaaagtagtcagtgggggagaatggcagtgaaaatagatggatgaattcagaatgaatagaaaacttgaagaggtttggcaggagtgagccctgcttagttatcatccaggtttcactaacgcgccccttgccaacatgcagtagctctgagtcatgatctatcatattgccctgttttgtaattttgcattgtttgtttacttgtttaggaccatctctttaacctcgttagacttgaaatctctactcaattcaagcctgcacatccccagtgcctgaaaccatggctgttacatagtaggtcttggtgataatttgtcagttggataattttagctggagaaaaagaaacatgtatgtgtgtgtgtgtgtggggggggggggttgttttgttttgtttttgtttttgtttttttcacccatcctgcagaaaacactgcttctgtgacataaagagaacaccttcacagggtaaagtgttcttcccatgaggtctaagaggagtctcaaatgcgaggggcttgaagacatttgtgaagggacactatgaaacatatgagagcagtgagaagtggagagttgtctctctgactgcagtagaaggatggcgaaacatcagggagggagaagggcactccgggccagtattcaggaggagagccttgtggcagcttttctgggtgtggatttcagagcctgtcatcatagaaagaaaagaaggaactcaatctaaagtataaataaaaggagagacttggccgaatgcggtggctcatgcctgtaattccagcacttcgggagatggaggtgggtggatcacaaggtcaggggatcgagatcatcctggccaatgtggtgaaaccccatctgtaataaaaatacaaaaattagctgggcatggtgacatacgcctgtaatcccagctacttgggaggctgaggcaggagaattgcctgaaccagggagtcggaggttgcagtgagccgcaatcgcgccattgcactccagcctggcgacagagcaagactctgtctcaaaaaaaaaaaaaaaaaaaaaaggagaaacttacagaaagcaagttcaaaaaggagggactgtggatgataaattctataccactgtgaatgttaactcgtaaggatttgaagataacggcccccgactcccacttaggttacagatgaagatactatggcccagggatgctgcgtgagtgtcttaaggaggaaaagagcgttaatgtgacatctgggattccaggctcctttccagacctctcccctttttcacttttccgcctgatttaaagtgaaaagaagggtgttggcatctattaatcacctactgggcgccaggcatggatgctaatggttaggtcttcaggttgctgagtgggtgttgaggaggaggaaccagtgaccccagtagacattgaagaggctcaatgacagcaggaggattcaggggtctggtggggtggatggcatgcgacgggcccagcatcagcagtgagagggtaggagaatggtgagtttcagggcatgcatccacagcgtaggttggtaactaaaaggccagcccaggaagaggcctctgcacatgaaacatagaagtggctgcctccttcaatcactgttctgattagataagacctgggcttcgcttctgagtggtaaactcagaggcagctgggagtccctgagtgacaaggaggagactggcatgccaggtagggcaggctgagggttaaggctctggagggagaagaatcgtactcagaaaacatccagctttctgggggatgaggttgtgcagtctgggtgagggacatcggatttctatggaggctttttggatgggacctgatataatcatataatattgaattcagttctatgagcttttgctatgtacttattctgtgcaaattctgcaagggatgtcttgaacggatggttctttcttgcattgaatgcaaatagtaatttattttgattgagatagttttggaaatttcggagcagtgaaatccaagtatttcaacctggcaggttgaggcaataggtaagttaacttgggcgggctcacttttctatacattttgtgctcgggaccgtaatgcaagcccactgcaaatggcaacttcatgtatcaacttataagcagtggtggaggagatctcaaccctacactcattgctccctctggctcttagagactggcttctaaattcctggtgagttgcaaatattcttagattggactatgctaacattttgaaattaaacctacctgtctttaaatgagttgttggctgcccctccccccgccccgtattctctttgtgaagtagaggcttccagcacttttctgaaggagaaaacatttatttctcattttgtagaggcaagaccaaatttgtgtcagcttcagctgagaccactggccagccctccttctcacctcccagttccctaatctaatttatctcagtggggtttgtgggggttcatttaagcagcagaagctctgctataattgttgcatgtgccagcaacgatttgtaccatctgggtatggaatgaggtggggtaaggtggtttggaaagagaaaggaacagagagagacaaagagactagtacgaccaaagagaaagattcttattccatgaccaaagcaatatcattcaaaaatggctacaaagcaattggatactaaggaatgagaagcaatgtagttagagtaaaatgtcaaagtataatgaaacagaggaacatcactactttatgatccagccaagttacaggcaggtggcagctgtaaatacgcatataaataacaatatggatgaaatgtcagacctttcagctggcttggttaaagcactttagtaatagtctatttagggtaacaatgtagcttgacaatttccatgaaaaatacatcattggagaatgagtcagcccgcgttagcgtgtaggtgatgtgcattgtgctaagagcttagaacaacacacggtgcctggtgcatcccccacctgcctagaatggccagttgcttcatattccatgaggttacgttggttttctggcattgggttgcaaatgcttgtctttcccattacagaaagtaccttttctctcttatcagtaacacaggaaaataaataaatgatcaatgcctcagatccggggtcttacctgtggaaaggtgtggattgatatctttatttattcatgcatgaaatgtatcaggcacttgctgtggtgccaaggatctaaaaaagtgaacaaaaagatgtataggctcagacttcatgaattttaggctacactgcttaaaacctttaatgattccctattcttaggataaagtcataactcctgatcatggctgccaagaccatgtagattacttagagtctggtgaaagaagaaataactgaataaaatggtcacaaaaggtaaatgtaaaattgcagtagtgaggccaggcacagtggctcatgcccagaatcccagcattttgggaggtcgtggtgggtggatcacttgaggccaggagttagagaacagcctggccaacatggtgaaaaaccatctccactaaaaatacaaaaattagcagggcatggtggtgcatgcctgtaattgcagctactaggggggctgaggcaggagaatctcttgaacccgggaggtggaggttgcagtgagctgagatcgcaccactgcactccaggctggatgacagagagaggctttgtctcaaaaaaaaaaaaaaaaaaaattgcaatcatgatacatgctacattgtttggtagccaggatggcttcctgaaggaacaggtgctagacttgtgatcgaaggggtaggaggttaaacagagaggtatgagagtagcattccaggctgtgggattggcatgtatgaagatcctgtggtaggaaggacattagtgagtatgaggaatggaagagatcattgtcctcatagttgagctagggaggtggagagtggcccaagtcaggtggggataagtaggcaggagcctacatggtcttgccggccatgatcgggagttatgactttatcctaagaatagggattcattaaaggttttaagcattgtagccttaaaaggacgagcaggggctggtcctttagaaggcattgtgttcatagtgtatgacagtaagccaggagctctgagaaaacaaatggcactttgatgagcaggcactgtatatagtttcatacacatgttaaagcgtgtatagaggatgtgtaaaacatccacttcatgccaagcactggtcaaggtactgagggtgcctgagtgtaagacagcatccttgcctctgagcaatgcacagactaaggagatggaagtcatagaaaccactgactgaagtgttgggcaccctgatgagattatgaagcacggaggagcaccttcagccttaagatggcattcctagagttcatgtcctctaaacagagtcttcaccaaaggctagaagttgtcctcgcaaagaaggagtggaggaagtgttggtcttctggtagggggattaagaaagccatagccagctgggcacaatggctcatgcctgaaatctcagcagtttgggaggccaagacgggtggattgcctgaggtcaggagttccagaccagcctcaccaacatggtgaaaccccgtctctactaaaaatacaaaaattagctgagtgtggtggcccatgcctgtaatcccagctactcaggaggctaaggcaggagaatcgcttgaactcaggaggctgaggtcccagtgagccgaaatcatgccacggcactccagcctgggcaggagggcgagactccgtcccccaccaacccccccaaaaaaagtcatagccaatgtcttcccaggaagtcaaggaagcaaggaagatgcccaggatcggtagacagaatgctggtgaagtagatgggggtgggccctcttgaccagtgtcttgccagattttcttaaaactgtaccatatcaaaggcagattgtctcccaagttatcaagtcaaactcgtgttctagccctgcagctcaccctgttttccatcatatgtgtgttataggctattatagatatgatcaagttgagtttataaggtccagaattcccatgcatgtgagaaagtgtaaactgaagccacctgttgggttatgtcccctaccttggtgcatgaaggaaaactacacaaagatgtgtggtatcaactcatggagacaagactctatctacaggatagcaaacatttggatagaacttgagaaggaatatggtggaggaatgagtttttatctaagccaagatccaaccatctctcgatgtatacattttctaccatgaacatgtgcaattgcccatctgtgttttctttcccttttgagattcctcttgaccttctgggtcctggggaagtcctcaggacaaggatggacctaggcgagttacatcaggtaccacagtgttaaagagtgattatcacagtttgctcctcacactttatatttggccagccctgggccaaccccttttcccagccctgggccatacccttttccaataataaagcccattttttatgattttgctcatgggttcatttattgatttgttcaaacacaatagggcactacctatgtgtcaggtaccatgctaggcacaacggattcgatagcaaaccagaccattgtattttctgccatcttgaagcctcagattgcatctggaatgaatattattagaagcagctagattttgattggaaattctctcttctgaatcctttagcctaccaaatgctttggttctagctaaataagtggtggttttatttcctttgtaatacctgaatatgtattccttggatacatcaccctccctatattgagaagtttcacgtttcagcagcctcattctttctcatccttgtggaatgcatgtgcatgtatgtctctgtgcacatgcatgataggtttctatccagccttactctccatgcaagaatataacagctcccagagttgtttgcaagaaaatattaaatatttacatagatatggacattttgtggggataatataagaaatcttattcacacttggccgggcaccgtggctcatgcctgtaatcctagcacattgagaggccgaggagggcagatttctttagttcaagagttcgagaccagcctaggcaacgtggtgaaatcccatctctactgaaatacaaaaaaaaaaattagccaggcgtggttgtagtcccagctactcaggaggctgaggtgggagaattgcttgacctcaggaggtagaggttgcaatgagccgagattgtgccattgcactccagcctgggaacagaatgagactccatctcaaaaaaaaaaaaaaaagaaaaaaaagaaaaaaaaaactgattcacatttcaatcaatgatagtcactgacattgaaacttactatgagccactgtgatgtctaagattcattctctgtttttattcttacagcacccctattaggtaaatattattaatgtcccctgtttggaaatgtcaagttcaatcccttttattaagggcagggccagctttaagggcacattccctgcatggtcatgcagggccccaggctttgaagagccccgcatgtggtcttatgctatagctggaattcttaatgatttttgaacaagcgttcctacattgcccttttgcactgcccccagaaattatgtggccaatcctgattaaggggcagggcagggctctgtggagggttgatgtacccacagcatccatccctttaacagttcctccacgttaggaccctcctctcaacattgcctatcctagagggacccccccttatacaaatacagaaggtacctggttcattcttcaagctgtgtgtggattctcattgtgaagtgaatcaccttttaatgtatagtcacccaagtacatctgctatgttgatatatcacttgttttatgggccgggattaattccaaagtaaacactaagtactcagctgaaaagctgtaaacacaagacaggacgtgcctctccaactcccagcattgtttgccaaggttgcaagtccctctatgctttatcctgtttggcgtaacaaaatcttcgtgtaatttggtctcagcagtcatttcaaattgattttaagagttgcaggcaagggggtattgtggttgggagaacacaccttcacgtgcattttgcctccctttcttgcctcagcatcacccaacggtcttcctgggatgttcaccttcctgagcttgatgggtgcccgtagaatcgccacctatggctgtgctctgtgcaagcaggcctgcagtggtagcaattgcaggaggcagtctactccaagccttctattcaagccctgagccctggagcagggctgtatcagcttggaggaaagggcatattttgggtattcttccactcggaaggtgtactttttttctttttttttttgaaacggagtttcgctcttgttgcccaggctgagtgcaatggcgcgatcccggctcactgcaacctctgcctcctggatccaagcaattctgcctcagcctcccaagtagctgggattgcaggcacgcaccaccacgcccggctaattttgtatttttagtagagacggggtttctccgtgttggtcaggctggtctcgaactcctgacctcaggagatccgcctgcctcagcctcccaaagtgctaggattacaggtgtgagccaccgcgcctggccttgggtatgcatttttatcactcatacagcgggtccatgaatgcaagcagtggctccagatatccaggaggtcacacagttgactgttgtgtcatggaatagcaaacactatcttccgatctgtgtcctgggtgctgggcctcctgacattggtgacccagttctgaattccagaatgacagttttaacattagattttgttagtttgtccatcttatttttatggcattagtgttgcgtggattgaaaatcacacgtacacggacacatctatttacgtataaatatgccttgccttgcattcttctatcttctttacttaagtggtgagatgtttgggtttcttcatgcagtgactttggggaagtccctggagctctttgatgctctgttccttcttcttcaagctgtatttgattgtgaatgttccttgtgaagtgttttaaatcacaggtatcaaatcccctttgcttggtttgagggatttgcctctgttgccctcatattttcagcctaagagggccctccccattcctcccagggacatctaaaaacgtttatcttcttgtgtgcagtctggaaggttcttcttacgagcatctagcctcacaccaagcagccaaagttgtcttaaaaaaaaaatagcatctttgatatgatccacttggccacagcagcttcatcaccccctccccaatactctaatgtccagttaacgtatattctcagtccctccaacaagcatgatctttgtgccccaggacatttgcacatgctgtttcctgaaaggctacattccacagttcctaccctggtgcctgcttggttggtatattcagccttgctcagcttggacatctcctctttaaggacatacttcctgattcaccttccaaatcagaacaaagcttcctgttctttgccgtattccagtaagttgccaactcactggacattttctcatggtgtgcaccacacgtctatactgccagagccatatgcattacaaagacagggaccttgtctctctggagccctaagtgtgtccttaaggtttgcaaaggaccagcgtctaatgaccatgtgaatgcaggaattatgtgattgtgtgtctctctgccttcccctaagtctgccgtgtccctgggccagtccactttgtgcccagatgctcactttcccatgctgtcctggagcatgtgctcctcaaatctctccttgttcatgttctgagaaagaaaatagctcatgctaagctttccaagtagacagaaaatgagccatgcctctctagctgctgttttttaaaattttattttactgttgcttattttttgtcattgttaaaggaaaaaaacattgacttctctgacctacttccctagcattctttccctttcctcttggcccctttgcaagcccttgaatatcataggaatatattccccttaaggtctttttgaccactatgtcttttgtctagaatgcaatttttttcaagttcttacctagttcactccctctcctccttctcagcttagctcattaccttttcagataagacctccttgactcctccattaaaatcagaccccctcttcactcccacacaccctgtgttcctttcctagctgacttttgccatattgcttatcaccatttgacatactatgtattttatgtttcatttgtgtctgtctttctgcactagcatgtaagctccaaccgggtagatattttagcatgttttgtttgttgctatatccttgcagtgcctttcacaaagtaggtactcattgaatatttgttgaatgattaaacctatgaatggatgggtgaatggatggatgaatgatggatggatggatgaatgcaatagatggatgggtgagtggatggatggatgatgggcagatgaatggatgtaacagttgggtgggtgagtggatggatgaatgacgggtagatgtatggactgaataggtgggtgggtggatggatgggcaaaagaaagaatttggccttgggttttaacatcagtagtaatctctactttctagacattgagttttaggatggataccaacaattattatgttttgagacacactttctggagaaagtccagagatccttttaactcacttggcatgggcaattgttaccttgcacttgccattttgtacaaaagtatgtttggttccgtgccttccttccttctctggcaaattgaaaattatgatggaaataagaatttccaaaaacctgtggaggtgaaagaagacataaaaacaaagccacagattattgtacatttcctgttgccagattaaagccttgcatccactgtgtggaacaatttaaaatttcatctgttaattggaaaagttacagatattgcagccattcaccttatattgcggggggacagttctagtttaaaatattctactatgctgtgtctgtaaatcacagaaattacctagaaattgcaccattttggcatttcaaaatattgcttgcacctggaaatagcaccagaaaatctttcccagatgcagtttgatttggaaaatataataaatgtagttttgggatttaacttttattctggtccatcttcttttagatgcttacgggccaccatacatacacatttattactacttttaccctacccacttggtaaaagttttgtattttatttttttaactgacaacttgttaaagacagaaattatgttttaatagtttattggttggatacttttagcaacaagtaattgaaaatggaaataaaattagtttaaacaagagaaacaggtatgatttcacaagaatgttagcaagaattcaagggatgaggcagacttagggttagataattcagttaattcatcaattcgaaaatatcattaaggtttcaggtttttgcaatatttctcctatgctagtctgattgtatttgcttatcctcttaggctgtcattcctcctgtttctattatagctgccattgctccagacatcatgtggaaactgcaacacccagaagaagaacaaaaaatatccctgtttaattttcctttttaggaaaatctccctagccagcccacgtatctcttccacagacttctggtatttcattggccagattatatgatttgccttaatcatttagcaaaatatatatatatatatatatgtgtgtgtgtgtgtgtgtgtgtgtgtgtatatacatatgtgtgtgtatatatgtatgtgtgtatatacatatctaatatatatctaattatgtatgccttatatataatatatacatatatatatctaatatacatatatattagaggggaacaacacacagtggggtctaccagagggtggaaggtaggaggatggaaaggatcaagaaaaaataactatgggtactaggcttaatatctgagtgatgaaataatctgcacaacaaaccaccatgacacacgtttacctgtgtaacaatcctgcacatgtacccttgaacttaaaaaattttaaacaatgagatatctaaatgaatgaatgaatagataaataaataaaagctattgtgttgaagaaaaagaaattattaggttcccaaaactgcatttccagcctccctcccaaaatttctgatttgatatgtcttgggcagagtctgatattctgcaagttttacaagttccctagtgatatgaaaatggctggttcttggaccacattttgagacccatcaacatggaataatcaagattgatctccttgacattgtggagaagctcgactcccttgaaggacaaggaagccatgtagtgagtgaggtctttaggtttctgttagccagataattatcttttgtttagttagctaagaataactgatacagctgacaacttatggcaataacattatatttcacgtggttgataagaattgactgaggatgaaaaaacaaaggcaaaacaatttttttttttttgagacagtctcaccctgtccccaggctggagtgcagtggcactatctcggctcactgcaacctccacctcccaggttcaagcgattctcctgcctcagcctcccaagtagctgggattacagatatgtgccaccacacccggctaatttttgtatttttagtgaagatggggtttcaccatgttggccaggatggtgtccatctgttgacctcgtgatccgctcaccttagcctcccaaagtgctgggattacaggcatgagtcactgtgcccggccaaagtaatttttaaataaaattttatagaataattgaggatgaatgtagaatttaagtctgagttgtggttaagtgtatttcagataccctccaagaacttagaattgacattcagctctacgcagtattccaggtcatttgtgtgtctgtttttgcatttccaaaagccgtacgttttcttggaattcataacaaccccattcactgggttgagcaaatattactggaagatgatatgataatccacatccagcaggagaaagctggggctcacagaggttaagagtttcccagccctcggaggtagtgagtgttggcattagagcttacagcagcatcctctcatatctcttagcgacttctgggatgtgagggggcacaggcattttgcagtgactgtgagagccctcagtatcagaccatccttggtacccactccagagagacttctaccctcccatttgttcttgtcttttaatttttcagcctcctgtgaggtgaacggatgtcaaggaggattaaagaatgaaacatgcttattttctctccttacgtgcctgaggacaggccagtgagctgtggggacaatagaactgtgaaaatcttctcctggggttcttttcttggtatttggcctgacataccagggaagctactacctctgtgaagttgtggagggctcctgcccagccttcggagggaaacagcgggtcacaaagagagttttccatatttacatgattgcatttgttgctgttttaatggctgctgtaacaaatcaccacaaatttaacagagtaaaagaaacacccggggtcaggagttcaaaactagcctggccaatatggtgaaacctcatctctactaaaaacacaaaaatttgcctggtatgatggtgggctcctttaatcccagctactcagggggctgaggagaatcacttaaacccaggaggcagagattgcagtgagccaagatcgtgccattgcacgccagcctgggcaacacagcaaaactctgtttcaaaacaaaaacaaaacaaacaaaaaaacccgccatgtattatctcacagctctgtgggttagaagtgtaacttcggcatgactcaactgggtcctctgtttagagattcacaagacggaaaggcagaagttagcagggctttgtttcttactaggggttgtgagaatgaatccacttccaagctcactcagctttgcctggttcagtccctggcagtggtgagactgaggccctcaaagctttgctggctgtcagcagggagatagccctggccttcagaagctgcccgtattccttctcctgctgtccagcgacagctactcgagtctctttttgctttgaatctctccatgtttctcttttgccacatcactctgactctagttggagaaagttgtccaccttgaaaggctcattccatgagactgggcccacccaggtagttcagctcttctcctgatctcaagatctgtaacttgaattacatctgcaaagtccttgtcttagcctgcttgggctgccataactaaatgccaaaaactggttggcttatcaacaacagaaattcattgctcacagttctagatgctggcaagtccaagatcagggtagagtgaatgtcaggtaagggcccactttttggcttatagaagattccctcttgctatgccctcagatggtagaagggacttgcaggctctctggagtgtcttttaaaagggcatgaatctagccaggcatgctggctcacccctgtaatcccagcactttgggaggccatggtgtgtggatcacttgaagtcaggagttcaagaccagcatgggcaacatggtgtaaccacatttctactaaaaatacaaaaattagctgggtgtgattgtgggtgcctgtaatctccgatactcgggaggctgacacaggataatcacttgaacccgggacgtaggggttgcagtgagccaagattgcgtcactgcgttgcagcctgggcgacagagtgagacttggtctcaaaaaaacaaaaaaaggtacaaatccccatcaacagagtcctacccttatgatgtaatcacctccttaaggccccgtcttctaataccatcaccttggtgttaagatttcaccatatgaattaggggtgagaggacttaaacattcaaaccatagcagtcacctttgccatgtaaggtaacatatttatagattccagagattagggcatgggaatatttggggggccgttctgcctactacaatgatctcatcacaatgataaatgttagcagacattgctctgataacgacaacagctgctattttttaaatgtcactctataccagccactgagatagatacttcaaattgattggatcatttaatccccatcacagaagagcaaagtagagactattattcatctcattttacatgtatattttttaaaaagccaagacattgaatgctttggtgtcttgccctgggtgactcagaaggaaagtgtgaagctgagaccctagccaggaggtctgactccaaagccttggctgctaatctttttgcataacccatgtcttccttgtatctatgccatctttatgatctgcttacttgtacattgccactcccttctggtgctcaatggctctgatttccttaagatagggttacattattcacccattacagaccactccaagacatgtgttttgctcaatgattgtgtgtgcacctgtgcacctatgcacatgtatataatggtggacagtttagccattggagctccccagtaggagccagtgacattagtcacatccagaaacacagtaaaatgatcaccatcgcaggtgaacgctgactcttttccaaaggaatatcgcagaagctggtaaaacagtcgcatccaagatcaaacaagacatcggccactggaggatggtggtcacttctgcaaaatggatcaggaggatttagaaagtcattatggcagaatgggatttggggttgccaaggcctattggacctcttttctagtaatttcacccctttcagggacatctacaagctattgttaaaaatccctgagtgtttggctctccatttcgtcttctgttaaatgaggcaatatctacaatgtcctctctaggcttttaattggatcccccctccccgcccgaaatacttcttgtattgtctgtcttttttttttttttttttttttttttgagacagagtcttgctctgtcgcccaggctggagtgcagtcgcgtgatctcggctcacttcaagctccgcctcccaggttcacgccattctcctgcctcagcctcccgagtagctgggactgcaggcgcccgccaccacgcctggctaatttttttgtatttttagtagagacggggtttcaccgtgttagccaggatggtctccatttcttgacctcgtgatcagtccacctcggcctcccaaagtgctgcgattacagggatgagccaccgagcccagctattgtctctcttctatcccttggaattgccttaagctagcatgttacctcttccagggcatggcacgcctcctgctgtctcttacccggtgtctgctaagctcatccttagaaccccaagttattttctacgtcaggggctttgcatattttactttttccacctagaatcctccttttgacattctttacaaacctagctcaatcttgtcagcaaactctcagctcacatgtcacttccttagaggatcctctgataagcccaattgaagtacacactcattacaacttgtaattaattgattttctggcctgccttctcgtgttgggtgggatcctctacaaatctgtaggcgccataagggcggagaccttggctgcttcatttgttcttgtgtctcagtgcctcagctgtacatgtaagtgaaataggtgtttgtggaatgacttgggagcagcaccgtcatctctactttcctataaggagtcttgtgcatggcctagcacatattctgtccccaagtccatggaaagcactgcctgccaggctatttgtgtcatttcaggaaaataagacaaagttaatagtggtggtaatacttcactagcttccaagatttgtcaggaatatgctgtctgcttttctaaagcccactctttactggagtcttagagtataccctggggatcctttgcttctgggtcaataggagcactcattaaatgcagatttgtgggtccctcttcaagccgatgaatcagaatcactaatgctgaaccccaggaatatgcatttataacaggcaacccaggtaattcttgtctacaccgaagtgctggaataactgatgtcgagtgtttgatattaactgttatctgttcatacatacatttttttgccccaaagcatctcatggtgcttctctaagcaattttgttgcttaaaagaatgacagactggataactggaagcagacatctctctaacagatctcatcgttccagttttaagtagaaagtgcatcatctgtgttttctgatcctgagcttaggttggagtaaacctgctcagagactttctccaggattagctagccctggggcacaggggaaaagatgcctggttttaggcaacagtgaacaccatctgggtcagcaataggattcaactgccaaaaagctagcacagttgtaatttgcatctaataaaaggagatttatagaacaacaatccttacagctctactctgaagtattgtacgtacagttaatgtcattgctgtttatggttttaccagacctatactatttaatagagataataaaggttaagttaagtgaatgcttatttcatgccaagctagcgcttctaactgcattatctcattaaattcataccacttcccagtgaggcaggtactcatgtttccattttaaggataagaaaagaggggcttagtagctcggttttaaaaagtcaccccaggtcctagggtggttaatggagcccagatgtgaagtttgcttcaactccacgatgtcctgccttcatctgagcctccccaggaagacagggctcggaatattcaggaaatgtcattgatctggatcccagctctgcactcactagctgtgtgtccttagcaaggcatgttactttctgaatctcagtgtccacatctgtaaaatggcaacagtgacgcttacctgcatgaattattcagtgatgatgcccaggtatccacatcattcctaggtgtgtgcaatcaagggagttatttgattaaacaagctgctctgattatatacacaatgctaggttggggacaccatacttccaaaggaataaggacaaattagagcaggaagagaccaaaatggtagaatgaccaggaatggtctctatgaatttgaggattttcagccacaggagagactgatttaatcaacacatatttacagagcacccactctgctccagggccctgtgttaggcacctggaaaacagaggcgaaccaaacagatatgtctcttatctctatgtagcttcagaatatttagcaaacactgcatataaatatgtacatattttaaattgcgatatgaaggataagtaacacaagcatctaacagaggtaactgatagagtatcttctagagaggaaatcagacttctttgcatccctatgtgctaatataagaattctgagttaagcataatgacacggagaactttccaatgagtctcctaggcgacctctcaatagggaacaagtgctaaagacagacagctgctgggtatggctgttgcagggggtctcatacataccaagtcttatagacttggcagtctttaaggtcaaccagattttatctgtctgccttctagggttttcttgaagacgtgcactttgaacaaagaggacattgggatgtaacaaccacagtggttgaaaaaccccaaatgcccagagagaacattcaacccttagaatgttagagagggcagtataatataatgggtgagaacatggattttggaatgaaataaacgtgggttcaaatcccagctctgtcatttagtagctgtgggactttgggcagataattcaactgtaaaattgtggtatgataataagagtgaccttgctagggtgtctgaggattaaataagattgtatacctacagaaaagtggggatataaactcggatctgtctactgggacaccccttatcttcccatggtgcacatgcaacgtcttccccacttccacttcatctctttggaaattacttttgccctgcctgacttcagtctttacagagtccttctttgtttcctgagagctcaatctatagccaaagtaatgagcctgatctgattcagcccaagaactctggtcattgaacttgacttggtatgtccatcatttgtacattttggataacaggttattgctaagagggaaaacctttagctgaatccaatacattcactgcaagtgaagcagaaggaaaatgcctaattccgacttgttagccgctgaacttctgagaacagaatcagcttagctgcttgcaaataagcgagcatcacagaacttggttgagctggcaagaaggtaacaagctgtgtgtgaaaaccctggcattaaatctccacagtaaagttgcttggtacacaggatcaaaagagctgaaaagggtaaggagacaatgagcaagctcctttctgcatacccgcccgacctttaccattgggaacaccccaaagagtgtatgctctggcaccttatcaaaaaataagactgtgctttagattataattaaaacaataaattcttctcccctgcgtgtatcccgattagattgttgacactgtgtcaagctgttagggagataaactcacgctgctacttgcactcaacatgccgcttatttttgagtcactcggagggtgtttttttttttttttttcctggtgacaacttggaaataacccattggagtttccttccttctatttctctatgaagttattaacactgatacacatggaacttcggaaatgggacagcttccatcttggtgttgatgtaggtcccagaatgagccttttaggaatctggggaacttatgtgttggtgaaaatgccagaggacacatgcatgcataggatgctttaaagtcttctgaagataggttgtttaaactgtggcaggaggtctggggtcagcctctgagcagggatttaggagattgtctggctcctcacccttgtttctccaagcatcaagagcaaactctttcttttgggtggatgccactgatggctgaccaagagtcaagggtggggaggttgcgaggatcacagggtcccgtccaaatgacctgattcaggaatttcgggtcttgagccatggtcccagcaaggctgagtaattttttttttttgaggcagagtctcattctgtcacccaggctggagtgcagtgttgccatctcggctcgctgcaagctccaccgcccaggttcacaccattttcctgcctcagcctcctgagtagctggggctacaggtgcccagcaccatgcccggctaatttttttgaatttttagtagagacggggtttgaccgtgttagccaggatggtctcaatctcctgacctcatgatctacccgacttggcctcccaaaatgctgggattacaagcgtgagccacctaattttttttttaattcttagtagagacagggtttcaccatgtcggtcaggctggtctcgaacccctgacctcatgatctgcccgcctcggcctcccaaagtgctgggattataggcgtgagccaccgcacctggccccagcctgagtgatttttaattcctaaacctatgaggctatgtttgtctcatcttcagacctttgcctatgaggttttgtcacttgcaatgaccttacaatggcacgcttttcttgggccacctcagctcatccttcatatctcagcttgcatgtggcatcctccataaagctttttaaaataatgcatattttattttgaaatagttttagatttattgaaaagttgtgatatagccctgagttcccatgcacccacactccgtttcctctcttcttaatgtctcacatcattatggtacatttgtcacaatgaataaaccacattgaacatggaaatttccccttttaaatatttttagtgtacaattcagtagcattaagtatatttatattgttgtgcaattactaccattgatctccagaactttttcatcttgtgaaactgaaattctgtccccattaaacactaatttcatccgtcctgctcgcagcccctggctactttctactttctgtctctctgagtttgactacgctaagtacctcatataaatggaatcatacattatttgtctttttgtgactggcttatttctcttagcataacgtcttcaaggtacattgatgtgttcaaggtgctacagcatgggtcagttttttttttttttcacttttaacattgcataatattccattgtgtgtatataacacatgttatctgttcatatgtcaatggacatttaggttgtttacactttttgattagtgcaaataatgttgctcagaaagcctttcttaatctgactgtataccccaggtgcacccttgggtcatctctatcatagaacttatctcacagagtataagagctgatttctgtgtctgcctctcacactagacttccacatccttagtgcaggtgccctgccagtaagttgttcaccattgtttccctatgatgtagaagagttcctggttcatgtgacatgctcagcaaatatttgaaatgagtgattgtaggaggaatgaatggatagttggttggttggatggatggatagagggatggttggatgaatgagtgggtgggtggatgagtggatggatggatggatggatagttgaatggatggaagaatggttggatggatggagggatggttgggtagatgagtgggtggatgggtgagtggtaggcagatgaggtgatggatggatggatggatgggcggatggatggatggatggttggatggttaggtgggtgaatgagtgagtggatagacggatgagtgtacgtatgtatgtatggttagatggaagagtggatgaatatatagatggggggaaagatgaatatatccagaggatgagcccaagcagattcctcaaggagtagaatttgatttatgccattgatctcactggggtggtcatgtgatgataaacaagagttcagggcaaagaaaacacaccaggttaaagtagcattgagcatagaaagagtagatctcagggcgggatgggggagtataatttgctttactttttttttttaacctaaaaatatttttatttagtgtttcagtaaattaaatcaatgacagtcttttccatgatcctactgccaagatagattttattgaacttttaagtataaaaatagtgcacagacagataataataggagaaaataaggaataaaatgaaaatgttcttcccaaccagtctctctataaagataaccacagtaactacgtcttgtttatttgccattattcttggggggattttctatgatttgtgaatatgtgtctgccatgctcttttttaacgagtgcctgtttgttcattgcataaagttaacaccacttaactgttcctcactgagggggacatttagctttaggctatttccaacagaactgcaatctctttaaaataccttgtgagtatatccataaggtaaattatttgaaggaaaactgctgggctaattttttttaatgtacatacacttatacattttggtagatgttcccagatgcccttccccaaagtttgcaccacctgatgttaccatgactcatttttattgctgtcagtcatttagtgtgggtgaggcacccttgttaaaagacataaggttggagcacatagtccagtttacttctgaacatcagtaggacatttcaaaaaaaatgagtcctgctattccctaatttataataaattctgagacgggggtggagatggcttctttacccatgagctatgcacattagatcaaaaaatgggggagaatccagagatgttgaactcaagcgtgatttgaaattctgtccattttcttgccctcagtggatgtttttaaagtagaagagacaggaaaggttaagactttcagtctctttcccttaagagtgatgtgtgattctctactgtctgggagctccagggcctgacccacagattggctgtcactaatgctgggaagaggtgtcactagtttagcaacccttcattctatgccatttcctgcttccatgggtcaaatgtcagcaccgttcaacacgggctgaagaagctgacaaaaaaggtgcttgggactggatctttcacagagtacaaatgaggtagtagtggaacaattggtgaacacactttagtatatatttgacacaatttagctgctatgcctggcatctctccttcagcatatcctgcctggtagttatcattaaaaaatcgaagaatatataacatgtttataatttcttctttttatccatagttcaaagggagaagcatagcttctcttttaagagatagaaagatatagacatagacttagatgtatgtcattattctcctttaggataaaaggtggctagggctttataaaatttcagtgtaaatacatggagtaccatgtatttaccaaattaccaaatagtaatttggaggaggggatcttcgtcaacaacataaactttccattaacagtaataccctcttgcagtgtcacacacgagtctttataacttaactcatttggaagtcaattctttccagtgtggctgaactataagtctgaaaccagtgttatgaaacttgcaaagaaaagattaagttattctgatatgaaaatctttattttagaatgcgatatttatgcagtacacagtgcaaatatacaacatagcgtttactgtgaaacgactccttccacttctgtccccagcaattcagttcttctcctccgagactgcactgtagctatttttgagcattaatccagaggcagtcaattaataaacaagcatattcacacaaatagtagcatgtgatcatatgacaggaaaaccaagttcccagactgtggcaaaattgtttcactaaggataaaagttacagaaagtatacttgtttggcagagtttattagataatattattagataaaagtgttagcaggataggatgaattcatggaaatgtgggatttctcttatgtatgtattgctttattaagagcaaacgcaatattaatatcacaggtttagacgtctgaaaaacatacagggatttggctatgcctttcataggctgtgtgatgtcagcaagctctccattcctctcaacctcacagtccttatattcaaaaagcagaagaatgtctctgtccaagggttgatacaaacgatgaatagcattagattaaaaggatctccgctaggtgcagtggctcatgcctgtaatctcagccctttgggaggctgaggtgggtgaattgctttaagcccaggagtttgagaccagcctgggagcatggcaaaacgccatttctactaaaaacacaaaaactagctgggcatggtggcgggtgcctgtaatcccagctactcaggaggctgaggcatgagaattgcttgaactcaggaggcggaggttgtagtgagccaagatcacaccactgcactagaacctgggtgacagagagagacttggtctctcatatatacatatatatatatttatatataatgttatatatacatagtatataatatatattttatacattatgtattcaaggtcctttatacataatatatatgtatatatgtttatatatgtacatatgtattatatatataatatatataaaggaccttgactatagtagtatttagcgaaagcagtttgcttgttttcctctttacctgctacccatattatgagttacaggagcagctcctcaaacagtaatatcttgttgtgctttatatggctaaatttaatggttaaaaaagaaagagagagaatgtggtggaatcaaagagtagtttcttctgatttactagtatgctccctccccaacctccacttcttggctgtgttcatacatgaatggagtgtgtagacattcattctcatctactaattgctttcttcatagacaattctagtgattacagggacattgattctaggggatgtgccaaattacctaagtgccatccagctctcaaactttttgtaacctccctcaagcaccttttgaactctacctattaactggcaagcaatcgagacgttatttaaaaatcaatattatcttttcattaaaaacagccccccggccgggcatggtggctcacgcctgtggtcccagcactttgggaggctgaggagggcggatcacgaggtcaggagtttgagaccagtctggccaatacggtgaaactctgtctctactaaaaatacaaaaattagccaggcatggtggcgcatgcctgtagttccagctactcagggggctgaggcagcagagtcgcttgaacatgggaggcggaagttgcagtgagccgagatcgcgccattgcactccagcctgggtgacagggcgagactccatctcatgaaaaacagaaaacaaacaaacaaaaagcagccccccatctctctcagctgttatgctgctgagtaaatggcctcttctcacctttttgtgttccccagtgcacttcaccttcactgtgaaggtcatgtattcatgcttctaatgttttacaattaaggataacatctccactttggtgaatttaatgagacttggcagtgaccccagtgacctggtgaacagccaactatttaggttggtgcaaaagcaattacggtttttgcctttttatttttaaaatggcaaaattaaagtggcaggaccgcaattacttttgcaccaagctaatattaaggagcctggctctaaagtcggactggctttcatcccttattacttgtgtaactctgggtaagttacgaatatgctttccctttccagttcttaatttttcttctgtaaaatgggcataatcgtagaactggacttctagaatgtctggtgaggattagatgagtataaagcgttcaccatgagggttctaatcatttagccacagtaagcattctttgtgtgttggctgttactgtgaatgccatttagttacctgaatccattcatccacttcgtctcatatattttccaatatttatggagtgcctgtgttggtcaaagcaccaatgcagagccgccatctttccctttgatttttgaatgtcccaggatggtactctagatggttccacacaatccagctgttgataacaaagacaggttgttcaccaaatcagagagtctttgagagttcagaagagtttaaaagagacagatgggtgcctctttcatggccccgagcttttctgtagaggttgtctttcacgtggagacatctctgttccttttattttctgttgactcatagcaactcgggagggagattattgaagaacaaaagggaggagtgtgtagttctgttttcaacactccttcaaagggaggagtgtgcagctaccgattaatagatttgaaggatgggcattcttttttttttttttttttctttctagatggagtctcgctctgtcacccaggctggagtgcagtggcgcgatctcggctcactgcaacttctgcctcccgggttcaagcaattctcctgcgtcagcctcctgagtagctgggactgcaggcgcatgccaccacacctggctaactttttgtatttttagtagagacggcgtttcaccgtgttaggcatgatagtcttgatctcctgacctcgtgatcacccaccttggcctcccaaagtgctgggattacaggtgtgagccacacacccagctaggatgggcattcttgtagagagagatagctaagatcatgtttctggcatccaagctcttggttataactctgggtttgctgcttgccacatgaatggcctcggacaagttattgaacctatctgggcctcagattccccatatgagaatttgattgtgttaaagtattagggtagctaacagagcacctgaaagttattaatttgaatatatgttggtaacagattataaagttgtgaggtagcatttatttggtgcttactatgtcccaggaagtggggtaagaagttcacatcatgtctggcagtgtagtaacctgcagaagagcca[131 bp omitted]ctcccacctcagcatcctgagtagctgggaccactagcacacatcaccacacccagcaaatttttgtagtttttgtagatactagagatgctgttttgccatgttgcccaggctggtcttgaactgctgggctcaaatgatcctcccacctaggcctcccaaagtgctgaaattacaggcatgagccataacttctggcctagtcagaatatttgtttgaattcttaccctcacaattacaagctgtggccttaatccctttccttaatgctttcttgtcttcagatcctccatctggaatacgtgaagatttaatgagatgatatctatataacacgctttgaaaaatgcctgacacgtaaagatcacttaataaatgttggttattcttactgtattaaacatcccaattattagatggtataacttgcccaggttcacacaactcagaagatacaagaggaaaacttgagttggttttgtcagctcttctgcagacgtagggggctaaatgagtaacattctgaaatgaagtcttcggcatctccaagggataaggatgcctggaaatttcacctttggggcacattctataaactgtacaaaattaaatccctcacttcatttccccagaaagacccctctgaagcattgctctgtatccttgcaaatctgtaccacgagacaaggggatgtcagtaggatttggtctccccacaaaatccctgcaaagatgtatgaggctgcatataaattgcattgaatgggctaacattgcttttatgctgaatatcggcaaaaagtatgaaatggagattacattttcaattctggctttttcccccaaagctttaccaagctgccctcatcctcacccctccatcatagtgcaattgcattggtgtggagtcctagctctcctttccttgctgggaagtgtacctaacacttgctgtcaggctggaaccgtgggtaacatgttccttaacagcaagtttctttattttccttcccccacatctctgtcctttttttctcactactttttgttgttaagacctgtcacacatgagaatcacaaaaccaactacaaataaatggcattcttgtggatgctaaaatcggtatatctgtctcttgggttgttcagggtagaaataagacatcgatgcaaatatggttcatccaccggcaatgagacacaggcttattatttcttcctgaaatacatatattcatatcatctatttcagtttgtatctccaaacagccctaaatcattgtgaggacctgggctccagtttgggtctatgaaaagagggtttacccgtggggggtcggggggtggttgtgcatctggttttacatcagcattaattccgatatttcaacagccccttcctgcccacattccttgcctctcccttctgccccctgaatattattgcctggctgactccccaaagagaaaatgtactaagcgaacttgacagattccggctggctccatatggcatggcctgagtttcgtgttcctgggacccccaagctgctctcaccttattacgatggtagtaactacatgcaagtcaagtccactgcattggttttaattccttgggccctggggactagcctcagacttcaaggtggcattggatgcaacatcatccactgcaaatatgacctttcccttctcttcccataaccacacagctggggggaaggtaggtggaaaatagaccctgagtctaggaaaatcttcgaaaaatgcagagataatatcagagggctttgctagggctggcagcagagtctaacaaagacatcttaaagcatcttgttgtttattgcttgatctgaacctttgcactcccacacataattgagactttgactttgattcataagtatataatttgaattcctccttctctctacactgttttaaagccatggagaaaattaactccaaatcgaataagtgcatttcaaatggataagcacttgcaacccgatgattaaggagtgcagttgaatcccatatgtttttaaataatcagaatttgttagaatgcatctgtaaaagaaagttttttgacagcttttcacttcacccagagtatatagaaaatgttgctaccttcatgtaatgtagtcttccatattctgacagaactatcattgcgtagaatgaagagaacacaaagagggcagagagtcaccttgttcaaatagctaaaagggatagcaagaggaagatagactttactccaggtggcccaagggaaaaaaatacatctaaagggaaagattttttaagggagtgaggagtgggaggagagttagagaaatagtgtagcaatctgagctgctgaagagaaagtgctttagtgttcacagtaggggctgcagtttgcagaggctagagagggggagtccctggtaccatgtctgaagttccttctaaccctgaggtccttgatgctgggcattggcacacctcacagtgagatgatttctgacacaaactggattggtcaccattataaatgattcaacttatttcagaagccacttttgccagctttccgctatatgcaacaaaaacctcaacctctgaatatgaaaaattcaatccatttgctttccttttagctaaaaggaacccaaaactgactccgcttattgctggatttgtatgctacttgctaaataaatggatctagtctagatgccaacaataccctgaggatgtagaaaacctcctttgcttgagtcgagcgccttgaaatagctctgttgcatcttgaacggggctagtttgttaattcgatgagtaaaggggagagtaccatcatttcgtttgttcccgtgcggaccgaacacggtattagcctctctgcagatacaatctcacttagacgtaccagccactgtgagagtgtagaagagtttatcccgaatccacaaacaggaaagtggagtcataggcaggaatgcactcaggttgtggtgggaagtggatcaaaacccagttttgtttttttttttttaattttaattttagggacagggtctcggtctgttgcctaggctggagcgcagtggtgtgatctcggctcagtgcaacttctgcctcccgagttgaggcaactctcctgcctcagcctcccgagtcgctgggattacaggcatgcaccaccacactggctaatttattgtattgtatagttttgtagagatgggggtctcactttgttgcccaggctagtcttgaactcctgggctcagtgtatcctctggcttggcctcccaaagtgctgggattacaggtatgagccggggtgcctggcccaaacccaggtattttactctacaatgcttgcccttttctcagcccttccttgcttgcaggacacctgaagtcccttgagctgctgtctatgggaaaggactcaagagcctgccttttcccgggtgaaggtagctggttgggcctggggtgtgaagcatgaaacaggtactgtgcatctcaccacagctcagagatggaaggatgcagcttcttctgcttttgttccacttcaagtctagcccctcttggggctgcttctctccgaggggaagtggggcacctggagggggggcaggtgtaggtgattggagctggaatttctctagtgtgatagtggcatcagctccacattctccccagcatgtcgaatttgtaacaaagctagatgtgaagagtcttccccagaacatccctcaataatttgttttaataatagacattttcagcttaaatgtgagtttttatcggagatttcccccttcccaatttgtgtcagcaaccgttattaaattcctaggaaaaggcaaatgttggggcttggtcagaagtgaggccgacgtataggtgccagttccagcctgatgttccccaccgatgtccatgtgctgactcagtaaacaactgcctttcttctgaatggtctatgtgagctgttgattatcatgttcttaaagaaggctgaatatcttgtgcctttcttgttaagcctgtgtgtcttgggacagctacacacactctctaagttacagttttctgagctttgggtgaggggatgttcgtctttttctgcctgcagcactgggcctcgggaagcaacttagggttttggctagagcaaggacagatctgacatctagtccttcttctgtgttttctgtcaatcccagtttccctctctttcaacctgagctggtagcactatccttttactgtttagagggttaagagagataacacctagtatatagtagctgctcagaaaatttctcgtttccacaaatgagaaagtgaatgcaatagacatttgagaacagtaaatgtgtaatagaattattagttctttgttctaattgtcaccggctccgtttaaaaaaatacatatatggtatttactttgggaaagctgcaagccctgtctccatcacctccttttttcaagcgtggactcattttcatctgcggattccctcttgcctgaaggccttggtgccgcatgagcaagtgcagtgctgagagctgtgtatggagctggaagcacaggccactttctgctgccgagaaatcttctgccctccgagggcacaggcttgactgcaaggggatgtgggaagccatttgtgagaagtcgtaattaatgatctgctgggccttggcacttatggaggaagcagaaagcagctgggaattgaaacagcctcttggataaaagttgtcctcctggggctgcttccctctgaggggatgcgagggacctgggagggaggggcaggggtaggggtctctgtagtgcgaattactcaatgctactgtcttttccacagcttatagggctgctacctgccatgcatgatatccaagtgatatggccaaagaaccctagctcttgagacaaaacatcctgggcttgaattctagctcttcctattgctccttacatctggacagttgccctccatctctgagcctatttttttcatttgttcaatgaggatggtgctacatactccgcaaggctgtctggattagaaactgagtaacataaatggaacagagtaaggactcagaagtacttgggataaaatatacagcaagaaacatagagcccccgtcttcagggtgcttacggttttgtggataatagaaatcgcattatctatataatgtgtaaacttgtggatatttctgtagatattgctgtagaatgtatgcacatatgtcaggtgatattagatataaattgctgctaaattattcagatacttctcataatataaattgttcttctttggtggaatattgggatgcctctgtagtgcaaattactctcttttggtgagttagcaagaatctatcataccttaatttgatcttacttgctgctaggctgatttgaaagttaacttacccttcagatgactaagggctattaaatccctgaaggaatcttgcagataactacagcaaataacaatatcttctattgaaaacatatttggtattccttgtaccaaccttataagaatgctttgagtatgacatgaactacagatactccttgacttaggatgggatcatactgcaataaacccatcataagtagaaaacataataagtcaaaaatgcacttaacacccctcacctactcaacatcacagcttagcctagcctgccttaaaagttctcagaacacttatattagtctgtagtttggcaaaccatctaacacagaggctatcttacaataaagtgttgaatatctcatgtaataattgaatgcattactgaaagtgaaaaacagtatggttattatgagaacgcgagatacggtttctcctgaatgatttcactttcacaccattgtaaagtcgaaaagtcttgagtcggggcgatctgtattgcctacaaatcaagccgtgcagcgtccacacctagcaagggctagtgatggttatcatagcaacaagtcctcctgctctatagtcataacaataatattttgtagcatctattccattgtgttgcatgaagggttacagaatctaatatatgcagaacgctgggcacagtgcctggtgcattgcattgtaagagctcaaacagtgtcagctgcaatcatcctcattaattctatcttcgcagtaactctgtgaagtgctttagggaggcgttacagtcccactttaccggtgagaaaaatgaggctcaaagaggcttgttcagtccgcacagctgacagtgattgctgcgtcagggccagctgtagccttattcctgaatttctccttatacctcttcagcccctccttccatttcatcccagttgttgttgttgttgttgttgttgtttcttaaatcaagagtttgcatgcatcttccctttgattgcctgggattttttttttttttttttttttttttggaaagcagtcatgaagatattgcctagcctcgggtacacaaattctggatctgctttccaagagaacccaggaggaagaagatgctgtgacaggcatttcttatcagggagaggctcccctgcttgcacttcgaatccacaatgatgaaggaattttccttcctgggcgtatttgcttatgttcttggatgtgctggtaagcccctgcctacccacctctatgtaaatgagtcctcccacaagctcgggatgttctgtccccaaatcctgaacaccatgtacaggagatgggcttagatgttgcagaagcaaagactgagaggggggcagcttttggctgcaattaactccctttttgactttatcctgggttggaaaagaccttcacctggctaggagatctgaaaatgtgcctatgattgtcagctgattttcccaggtcatgaacctgggcccctcagcctggaacaccgtgggaggagagggaagccaccctcgtcactaaaaggtgctacccttttattcaccttcctcaagttagaagaactgtttctccagctgtaccaaggctgtgctggaattgggatcgcagagcagtgcagaatatttattaaccacctactatgtgactgcggaaatagactcatcaaactattttgggtccctcctggatgctgtgagagacctaaagtaaatcgttgcaatacttgggttcttgacgaagagcgttggcttcacaatctggcagacctgttgtcctatcccagatcagacttactgaacctgtgaattggggcaagttatttatctcttctagattcatttcccttacttgtgaaagatggtaataatgtgtgtcatgtaaaaatatgaggatattagataagcactttgtggtgtcttggacctaaaaagcagttagtgtgtggtggacattgtatatctttaatatccagacctttcctgggatgccaaccttgttatctacagacatactgcctgagggtggaggtttgaattgaggatacagataggacagtgttcttattggggtggctgataatagaataattgcttatttatcttataggttgggaaatattggtattttaaaggtgggttttccagagttgggtataagttcagctacccaagacaacaggttactggggctgtatggctttgcatccagagttaaaagccaggcctgggaataattaaaatacttttcatcctgggaaattctgctttaactggtttatagcagaggctgcgcatcagatgttttcaaaattaagtgatggtttatgtacaatctaattcatccgcttaagtgtacagtttgaattttgatgattatatacaatctcacagtctccactacagttccttgaccttaagtttccttacgctttattttcagtctattctgcccccccattccctaacccctggcaagtattaatcagctttctgtccctgttgttttgaatttcataataaatggaatcatactgtgcagagtcttttttgtttgagtcctttccctgagcataaagtttttgagattcagccataattgttgcacatattaacattttgttccttttcattgctgagtggtacgtcacggtaggaatataccaagatgtgtttatccattcaccagaccaattaatggacatttgtttctagtttttggctattaagaatgctgtggaatttgagtacatgtctttatgtggacacatgtcttcattttggggagataaatccttcaaagtagaaatgctgggagacatggtaagttcagatttaacattctaggataccattattgttgttatccaaagtggctgtgccattttgcttttccactggcattgtagcattgggtatttatttattttttagacagagtctcactctgtcacccaggctgtagtgcactggcacgatctcagctcactgcaacttttgcctcctgagttcaagcaattctcctacctcagcctcttgagtagctgcgactacaggcgcccactaccagagctggctaattttttgtatttttagtagagacaaggtttcaccatgttggtcaggctggtcttgaactcctggcctcaggtgatccgctcgcttcagcctcccaaagttctgggatgacaggcataagccacagtgcctggctggcattgggtatttttcgcacagctcccagatgtttatattgttatgtatctaactagcatggatatcctctgggctctgttttttctgatttaatggccacctttgggctatcagatgaataaggatattgtcagtatcaggaaagtaaagaagacatttgtcccaacccatatgccccaagttgttcaaaactattgaggaaagagatactgtctgggttttcataactcagttgcatttttatgtcttgcatatcaaaatttgtatgcagggttacgttccccaacattaatccacttttttttttttttaataacagaggacttgacttagataaagagaagtcttattccctcaggtaggaagttgtttccacctgctatagacacattagttaataatcaagggacaggtgtgttcactgacctacctgttattttgttttacaactataatgactagttctgtttatgcatgcacacacagctgcaccctcgcgtgttgcttttccctcatgtttccaggcagaccacgcagtgactatttaatgctttgccttgctatgcgctgttgcttatacatttctggaagacattttcccatcctctgcagtttaccttgtacttttattttctccttgttgaattacaaatagattaacacgctcaataggttttccttgaatccagctgaatgcttcaacctcccacatgtgctttttttagttttgtaacatgacagggaatgaggtgaatgagctgaggatgtggcctttgtcttgggctgaagcagttctcaacccccagatggcttgtccctactcccccaggcaagagcccatacctcaagattataaagagaggttttaaatagaagattgttctatctaaacatgtgcctaactgacatctattttgttattatgtgaaacacatccatatataatgtatatgtatccataatgtatgtacatatatgtatttcccaactctctcatgtctgaatattacatcccttgactatcttctgtggctctccgagtccacttggcatttggttatcagcttatacttaacagcaagtgtcggtctgcaggcccatcacctatttttgtaaataaagttttattggcacatagccacacccatttatttacatattgttcatggttgctgttttgctacaactgtgaagttgagttgtgtcaacagaaatgtatgccccatagagctgaaagtgtttcctgtctggctctttacaggaaaacacaatttctgatccttcttctgtgctaccacttggtgtgtttgcaacttcactgtgctgtctgtgggtatttgtgtgtttgtgtctttttttttttttttttttttttgagatggagtcttgctttgttggccaggctggagtgcagtggcgtgatctcagctcgctgcaacctctgactcccgggttcaagtgattctcctgcctcagcctcctgagtagctggcattacagtcctcctgagaacctgccaccacgcctggttcatttttgttttttttggtagagatgcggtttcaccatgttggccaggctggtctcgaacacctgacctcgagtgatccaccctgtcccccggcttcccaaaagtgctgggattataggtgtgagccatggtacccggccttgtgtcttttctacgtggacagttagatttgtccagttaatcttaccttgggccagtcacttaacttctctcggttttatgtctacatccataacttgggcataataacagcatctcccctgtagagtggcttgaggattcaggggaaggcgagcaaagcacctggcattcacagtgtccagttcacatgacgagctcatttaatggcacccaggcttgatagaaggtatgtgttatgatctgggtggtatctcctgccattttggagcagatgctaagaagcaagtcattcagctgaggtctaggggaatagacagagatccaggccgttactaggagacaagctatgcaatagtcagggttccaacattgcctgcctcttccagcatccgtcacctcctgtttttgttcagcctccttgccactctgcagttagttcaaacacaattctcacttcaaggcatttgtttttgtctttttgaaatggagtcttgctctgtcacccagtctggagtacagtggcacaatctcggctcactgcaacctctgcctcccgggttcaagcagttctcctgtctcagcctcccgagtagctgagcttacaggtacctgccatcatgcccagctaatttttgtaattttagtagagatgaggtttctccatgttgggcaagctgatctcgaacacctgacctcaggtgatttacccgcctcggcctccaaaagtgctgggattacacgtgtgagccactgcgccttaaccactttcaggcatttgaacttgcagttcccactgcctcaccttgtttcctccaagacatccacatggtatactccttcctcaactactttatctcaaatagcggccccatcactgtcttgctccacgccctcatactcatcacatgtatgggtcattgtacttcatatcaatgtgtttatgtgtcagtgtcctgtctcctgtactgaaaggcactccccatgcagttgagaaattcatcttgttatatgcccagcacagtgaatttcacctgcgtgaaataggggagcactaaatattagttgagtaaatgcatgaatggatgaacattccttaaagtgggaatgtctttccatgtttcagaattctcatctgccatctctcttcccatgcatgaagataagcagtagactatccactcctgcacctgttcatatacatatagaaacacgcactgagaccgagcaccacacgcacagacactcacacacacacatgcattcaaacctctccatgcagacacattctctggagcagtctggatgcagcttgtaaaagtgcctcctcattcagcacttggacaacctaagagcctcttcagtaagatcctgatagctttattggagaggtcttgggtagaaaaaaagctgcagcttaatgaaggccttttaacagtcaatctcaattccaaggaaaagcaaatctattaccagcgtccgataatttctgctcagggattcccactcttggaatggatttttttttccagggcctcttttctaattaactctggagcgtagattacaagaggccggccttgtgaatgaagggggcacctcggcggaagtaatcactggaggtgatgtttaattaaagagatgctgttagagggaaaagacctgagcaggctggagtgctaatcctcttgccgtgctagtgtgtccctgcgtgattgtgattgatgagctggtcctgctcacatcttcatctgcagcgtgctcatccctgcaggaggggcttcagctccctccacatacatgcttagcctggtgttgttctggcatggtgaaagggatggctgtgcagtttccctttctcactctgcatttttctccttttctttttctcctttattatagctagatagttggatagatacacatttagatatacaactatgtacagatatatatggacctctatatctatctactgtctgcctgtctatctgctatcattctttcgttgtttgtctatcattctatcactctgtacattcatacattcattatccatatatacattcatccattgtctacctatctactatctacctgtcattctgtctatacatacatcaatccatcatatgtttatccattctgacatcgtctatctatacgttcatccgttacacacctatctactatttacctatcactctatttgtctgtacgtacatcaatctgtccatcatctatccatctatctatacattctcacatcccttatctagctatacattcatctattatccacctatctactatctacctatcactttatttgtatatgtatacatctatctatacatatccatacattaatctatccatccatctatccatctatacattctcacatccattatctatctatacattcatcccctacttatctactgtcattttatcattatgtttgtctatacgttcatcaatccatcagtctgtatacttcacatgtccactatctatgtatacattcatccattatctatgcctctaatctctctattgctctgtcattatatctacctacctatgcatctatctctatctttataaaatcttgctgtgaatctcagcgtgtctgtctccccatgtctgtgtctggctttgtcttcatttttctcattctgtccaaatctctctgtttctctgcctctgtctgtctctgtttcactgtttgtccttttgtttctcctaggtctgccctattaggtaattttagggaacgtgtaactgatacctttttttaaattcaagagtattaatggttgagtaatgtaaaagcaagtttttggttaagcatttactaaatgacaggaactgcctgaggtaccttttggcaagtatttcataattgttcttaaaatagcaaatattaatctcttaatatgtgccaggtcctaatgccaagtactttatgtattaatcccatttaatcttcaaaatagtcttatgttgtagcttcttttgctgttcctattttggagattaaaaaactgaggcttggagagagaattattattattattttttttttgagatagagtcttgctctgtcactctgctgcccaggctggaatgcggtggtaccatcatagctcactgcagcctcgaactcccggactcaagaaatcctccaacgtcagtctcccgagtagctgggattacaggcacacaccactatgcccagaaaattgttttttattttttgtagagaccgttttttttttttatgttgttccggctgatcttcaactcctggcctcaagtgatcctcccaactcagccttccagagcactgggattacaggtgtgagccaccacgcccagctaagttatgcatattatctttaatccacactttcgcacaccaagataacattttatttccaccttttaatgatgcatgtacaatggttttaaaagttaaggtgaattttccttggtcagagtttttaaagaatgtcattctagggatcttacttcagatgtgtctctctccaaaatgctccttttgaatggacagaaaggtagacctgtgtctccccatgtttctctgtgattgctccccctttaaatctgtgtcccagctacatttagtgaacatctttgccatgtggcttctgaatggaggaggctgcagaacttccttcagtcttctgagccataataaattggcagaaatgtctgatttgacgttttcccccccttgttcaaggcagatgcttttctcattactgagaaaagaatgacactttgtctctccaagagctcaggcgttcataatagataagtgtgcagtttctgatcttggagctgctagctctgctagactaggggaggctcagctctatcagggctctatccctggcgagattaggtttgcagaatctctactggagcttgtagctactcactagagtggattggtctatgattctagtttcactgtttatagttcaaaattttccagccagccaggctgtcttcttaattagaggggttgagtctgacatggaaggagtggataatgtacctttactccccattttcatctatcaatggaaaagaattaaaataaattcaactgtgacttgtttaactcccacattaacttgggttagcaaattctactttgtggaaggaaccatgaggaagaaaacagattgtaactatggtctgtgctagttcataagtccaagttcaactctggttgaggtgggggtgttgatagctttcactaaacctcaaattgttcattatcttctagtcttggtgaaacaagctttcccatgtctcaaaaagacccacctaataaatataatcaagtcccatcttacccagaaacagcacctgctgttactctctgattctcattgttttgctctgacattagggtgtctttatcagcctaaggatacatagattcttagacagtttcaatctcttatcttctttaggtggcctaaaatctaacactggagatctcttcatcatagcacccttggaaaactctgaaagctgtcataggtctagaaatccatcaactccagattctaaagagacaaccaaatggctcacacttcttaccgtacctgcacccacaaatctggctcttaaataaagtcatcagccctctaattatactaagatattcaaatcatgagattcgctctgaagccaattcttcaaccacccacttacccatctttgctttccgggcattgccacatccctttttcttggggtttcctccgcaggaacactccttatctgcgactttggttgactgtaaatcttgtactgttgctttgctatttaatgcaacttgtcatcttgtttttggccttgatttgatatcctagtaagggactcttcttgggttttgctttaagattcagtctgctgaagggctgtgactccattgtgagcagaagcagcctgggaaggcaggactagacacaccaaacatcagccagacaggtgatgtgatccctctgattttcagaattcctttgagagatcacttggcccttccctgctgatctttgggctggagtcaaggcaatcttttgaattagttctgtctctctctaaattatttgctttatgtaataggaacatgcctcatttgggctctttattttatctattttatttgaaacagggtcttgctctgtcacccaggctggagtgcaagtacatgattgtggctcacagcagcctcaaactcctgggctcaagcaatcctcctgcttcagccccctgagtagctaggaccgcaggcacatgccaccatgcccagctaattaatatatatatatttaaaaacatgtccttgtatttaacagaattttaaggaagaatttgatttttagtaatttacaacttctctggccaatcttccaaatctggctaattttcattgtaccactccgtgtgttccttttttgtcattctgaatattgatgattatagtctatgttcctaacgcctaggctgataacactctactcagcctactttgttcacatttccagcatcagaatcctgtgttccatgcttgtatgttgtggaacgagctcaattttcagcattaaatttaccatgccaaaaggtggaaaaagactctgcaataaacagactacttagcatgattttgtctgccttctgcatttggaattcccaacataacctaagcaggcataaaattcagttctttaagattcgtttaccaataagaatgttgtaaaaattcaaataaaaggaatgcagattagcagagagaatgctaagcaagttttttgtttctgtccttggtgctgaaaaaaatgggggtcaacttttctaccttagtgaatttaatgatgtggtgattgtatttaaatgactatgtgacaagggatcagatacttccctataatcattctttagtttcctagaactgtagaagcttggtggcataatgagagctgcctgtcacctaccctagaactgtcctgtctcatatgacagccactagccacatgtagctacttaaaacgacactaaataaaattaaaattcagtttcttagtgatatcatttagatattgtcccatctaaatctcatgtcaaattgtaatccccagtgttggacttagggcctggtgggaggtgattggaccatgaaggcagatttttttatgagtggtttagtgccatacccttggtggtagtggcatgatagtgaattgttgtgaaagctgactgtttaaaagcggttggcatcttccccttcactctctcttgccccgactctcaccatgtgacatgcctgcttctgcttcaccttccaccgtgagtaaaagctccctgagacctccccagaagccaaactgatgctggcaccaaccatgagctaattaagcctctcttttttgagacgtcccccaggctggagtgcagtggtgcgatctcagctcactgcaacctccgcctcccaggttcaagcgattctcctgcctcagcctgccgagtagctgggattacaggtgcctgccaccacacccggctaatctttgtagttttagtagagatggggtttcactatgttggtcaggctggtctcaaactcctgaccttaggggattcgcccgcctctgcctcccaaagtgctgggattacaggcgtgaagccactgtgcgcagccttaagccccttttctttgtaaaatacccattctcagggatttcaagaacagactaacacactcagtcagactgtctacctttcaggcgctcaacagccacacgtggctagagtttcctgtgttagacagtacagatatggaatatttctgtcatctcagcaagttttattggacagtcttcccctagaatcattgcaatagactcagtaacgcccacaaatctgtccacatcataatcactggaacctgcgagtgttactgtatatggaaaaaggacctatgcagacagatttaagtaaggagaattatttcttttgaattggagagattattctatagtatccagatgagtccagtgtaatcacaacagtacttacaagggggaacacagaggtgtagagtcagagtcagagaggaagaaaatgtaataacagaatcagaaactggagtaatgcattttgaagttggagaaagagaccacaaggtaaggaattaaggtggtcattagaagctcaaaaatggcaaagaaaccgatgatcctctcagagcctccagagccctggtgacaccttgactttacgtcagttgagaaatcagaactaaaagagaatatgtttgcattgtgtgaagccacaatgtttctggtaatttgttataacaacaatagaacgctgataaaatcatcattatcattgtcatcatcattatcgtcatctcagtaggtgcttggttttagtttgggttcttataattttgcattctcaaatagaaagtcaaaacaatttcttagttatttgaagaaccacactgataagcaatggcaccttttattttttgagattttcttattggcttgtgaatgatttcttctccgagagtggttatggaggcttaaacagtatgtcatgagttagcaatgtctagtgggggagctataatagataaaggtgagaagagataattcacatggccccactttctgatttttttggactgggatgtttgtcaattgcaattctcgttttgagcatggtggtcagatgagattggccttgctgaagcacaggcaagcatcccattaaatgcttttaggtgattcagaaccaaagctcaattcagtattttaaaggcgccctttggggagaccatctctggccttcctaccattggcggctagtgtgttattttccaagcccgctgtgtgatgatgggtgtgatgtgtcacactccttctctgctccctcaacatgctcctttcctcccaggctgggtttgatggattattttttctggaaaattttcctaaccccctgcacactgccatccaagtcacttcgcttaaataacaataacagcaataatagcacagagatgttcagcatagtgataagaaatttactttcatgacctaatttattgtagaaataatcctatgaagggtatgcagtttttatctctcttatgacagagaggagccaacactcaaaaaggtcatgatacttactcaaagccatatacctggtaagaggcaaagccagcatttgaacaacaggccttctgagtctggaagtggctttcattccgaaactcagcagaagtttctccttcccaaatgcttgagctccttaatatcaggaactgtgttacctactttttttttttttttttttgcactataaaatcttcattctttattttagatacaggaggtacatgtgtaggattgttacatgggtatattggaccaaggtaatgagcatagaagccaacaggtagttttttactccattccttcctgccattttagtagtcccccgtgtctgttgttcccttatttatgaccgtgtgtgcttgatgtttagctcccacttataaatgaaaacatgtgatactcgttttctgttcctgcattaattcagttaagataattgcctccagctgcatccatgttgctgcaaagacatgatttcattctgttttatggctgcatagtattccatggtgtagatataccacattttctttatccagtccaccgctgatacacacctaggctaattccatgtctctgctgttgtgaatattacagtgattaacatacttgtgcaggtgtctttctgagataacaatttcttttcctttgggtatttccccagtcatgggattgctggattgaagagtagctctgttttaagttctttgagaaatactcaaacagctttccacagtggctgaactaattttacacacccaccaaaagtgtatcagccatcctttttctctgcagcctcaccagcatctattgttttttgactttttactaataggcattttgactggtgcgagatggtatctcactgtggtttagatgggcacatatttccctgatgatgattataagcattttttcgtatgtttgttgactgtgtttatatcttcttttgagaaatgtctgtttgtgacctttgtccatttttttgcatgtgcagaatttattcaagttttaatataattccatctttaagtctcagaaacctttttacatttattttaagactacacattgggtacagtacacactgcttgggtaacgggtgcaccaaaatctcagaaatccgcactagagaacttattcatgtaagcaaacatcacctgttccccaaaaaccaattgaaataaaaaataaattactttttttcttctccattcaaagatactagactattttttttgaaaatcagcagaatttcattgaagttcctcatttaaatttatgtttgaatcctgtagattcttaataagtacttccatacagagaagaagctaataagaacgttccagagagatcctacagaacgtggtgtggtgggaagatactaggctgggtccacattctgtctctatcagcagtgagtcagtgcacacatcctaccttctgggcatcagtttcctcacctttttattttattttgttttacttttgaagtagggtcttgctctgtctcccaggttggagtacagtggcatgatctcagctcactgcaacctccatctcccagttcaagtgattctcttgcctcagcctcccaagtagctggaattacaggcatgtgccaccacatctgtctaatttttgtatttttagtagggatggggtttcatcatgttgaccaggctggtcttgaactcttgacctcaagtgatccacctgccttggcctcccaaagtgttgggattagaggggtgagccactgtgcctggccaagtttccttatctttcaaatggggatagtgatatctaactcagagcccttatggggatgtaatgaggtaatagatgtcagtcacttagggtgtatacatgagtttaatcatcatcatcatcatcattaataccatttctgtacccccaaagtgtgtgttcaagtacttgtccacattcagtggtcatagcaaggcctcagtttacttgaatgtatttacattccaacaatgtaaaccttaacaaagactttttttttttaaatttgaccactgcagtgttctcatagaaaagactacagaacagaaaaaaaaaaaacagtttgcattgtgtaattgctccaaattgtattttcttttagaaaataaaaaataaatcactagaatcctatttaaatacaagtttaaaaattaattattttgcactagacacagaatggactgaaaaaattaggattagagtcattggtacccatacagatgtgaagaagttgtcctgagagtgagcctctggtttcatctgtgcttctctgtctccacttggctttgtcacgtctcccataaatgaccacagtcattttattgcctctctccatgtccccaccttttcctgtctccagcctaccagccatttagtggccagcgtggtctttctaagacaaacctgaccatgtgaatcccatgcctggaactcttcaatggcctcccgttacttaaaggatcaaatacaaactactttatgtgtcattttctgattctcttcctatgcccacaaccttattttctagccccagttcctgctaaatcttcaccacacctatactccagccatattatcctgttttctgtgttcttttatgccctgatgctgagtgtgtgcttttcctcttccttgaatttgcacctaactcactccatcatctcctcaagattcctctcaactgctacatcctttaagaagcatttgatacctcctgtctctgaattgagagctttcttctttgccccctataataatttatacttataaaatccatgacacttgctttgatcatcgattttttggtatctctctttatccagatcttaatctgcatgagagcaggactattttcttatctctgaatgtattttatattaatgcaaaaacaaatgcttattgtgaacctactggggaccagacacagtggataaaggtacctctagtgcatttctaaacatagtcaaaaactacatttcgaatgaattaatgaatgcaagatatccttccatgtgtcactgagacttttaaaaagaactagtttctttctgatcaaattcaatggataaccttgcagagcaagatctaactcagaatgtctacggatgccttaagcattctgcatactggagcgttttcaagagcccttctctgacctcacacacagcgaatgtctgagctctgtaggctatttgtagagagtttatttcatctttgcagaaagctgcccagtataaatattagtcagttgatttcacacagagtaaaaacaagcttttaaaagcttttacctctcctgtccccaaataggtgctttagacagattctctgagccttgggagctttgttggatttggtaaagtgaaagttatgttctgttccgaagcagccttctgtgaaggctgtcttggggttgatgctgtaattgtgcagaaaggtaaaatgaagaataacaaaggtggcgtgtggggtgggatggagatcaagcttccctgttctggatatatctccataagtccatttcaaaaaatgttcacgtttggtgccaaggtggtcacttggtattgtaaaggagtggtggcttcaaatttaaatagtctaagttcaatcttagctctattaatgaactagctaatggtgtacatgggtctcactcagcctctatgacacctgaaccaatgagtatagctagcattgtccaacagaaatataaccatggtcacaaatatgaatcacatatgtagtgggtttttttttatactttctggtagccatattaaggcaaaacaaaatgcgtgattttaatttcaatattttattcaagcagatatatcccaatatataaccaagcataattttatttacccagtatatccaaagtgttaccattcaacatgtaatcaaactgacactactaaagagatatgttgcattctttctcttgtatgacgtctctgaaatctggcgtgcagttgccatgtacagtacgcgtcatttcagaccagccacatttcaacacccaatgaccacacatggctagtggctaccatgttaggacagcaaggtgaaactacaatgcttaagctgatctagcaagctcttaaagctctctgactaggattacaatatctgcttcacagagagcaaatgagatcgcatgaaaattgtcatgcgccccaactttctcctctgaagtgttagtgtataagcaacagattaagaggataaggtgtcacaacatccttagctgtttacctaattgttgcatttctatcactggacctcaaactccatgaagtagacagtgacatcactcaatactaggtcttccgtgactagcacgtaatagatgtattaatttcccagggctacgaaaacaaagaaccacaaactgggtgacttgaaatagaaatttactggctcacagttctggaggcctgaagtctgagacaaaggtgtggataggactggttccttctgagtgctgggaggacaatctgccccatgctgctctcctatcttctggaagtttactgacaatctttggcatcccttgagttgtagaagcatcacccattcatcttcagatggtatgcatatctgtgtccacactttcccattttataagacacagtcatatggattcagaagcccaccctgctcgctactcaggcatgacctcatcttaactaattacatctgcagtgaccccattcccagattaggttacattctgagatactgggagctgggactttagtattggaatttgaaaataagacaattcaaccaataacagtatgtgttcaataaattcaagtcagatatatgaaaaaataaaaattgagtataaagataatttttggctacattgactggattccaagaatcttccattctgtctaaagaagatagacacgttaaaaatcaaacgagaaaaaacagtaagtgaagaggatgaatgcagccagtgggtagttagactatgcaaaaacaagtgcgccagaatcacaactcaacatatattaaggctttcatttggtggtgttttgaattagaaatatttaatgtcgatcagcctcagtttccttagcattatctacttcgcagttgttgagacaattaactacaatatcctaagttgcacacaattattgggccagacttctacactgtgagtatctgcaaaaaaaagaaaaaaaaaaaacattgttcactgctgtgcttcttccctctgatttaccaataagggaaacatcttccatatttccaaaaacccctggttttccttgagtacaccttgacatcatgcaaaacctcttcttcctcaagtcagccaggccctgctgtactctaagctgcaacccactgggctcagcattcaatcaggcagacgtccttaaaagatcacacattcttagctacggaagaataatatttatgcactgcttaatcatgtgaagaagcacagactctccagtctcaagtggagacattgggtgatgtataggcttagagatcctcatattgggaaagagtcagttactgatcttggctcttcacttgccaagatggaactgtttggtttcaattctgtgaacatacttacaaagtagtaggaacttcaatactgtgtgcttctgcttagttgggttgtactgaatttgtaagtccagtgaggttgtattttccctttgttctgatgagaggtctagccactttgtgtttcaactgttataatgtccatattcagttttcttattcccccataaaagttcatgagatagaaatggaggaaacgtagatatgcatcatgcatctaagcctattgttgtagctagacttgtcgggtcatatggatgaaaatatcttagggaacagtttgatgcattggaaatacctctagggttcatatcactagatatgatttgggcatttcactgagttacctggctctcagcttcttccactaaatagatgtgaatgatacccattctgactttctttcaatattgtatgtaaggcttaaaacgattatgtttaaatgctcccaataacctttacaacctatcccatgatatggtttgtcagtgtccccactcaaatctcatcttgaactctagttcccataatccccatgtctcgtgagagggacccggtgggaggtaattgaatgatggggacagttacctccatgctgttcttgtaatagtgagtgacttctcatgagatctgatgggtttatatgaggctttccccctgctttgctcggcccttgtccttcctgctgccatgtgaagaaggacatatttgcttccccttccaccatgattgtaagtttcctgaggcctctccagccaggctgaactgtgagtcaacctctttcctttataaattacccagcctcagatatgtctttacttgcagtgtgagaacagactaatataacccagctgagatattttgatgatggtgatggagaagagaatgatcatttgtcctatttacctaaagtgactacttgtttcctctgcttatttcttctatttcaagcactagagttacttccattgagaaggtaatgtcaaaatgtagcttaaattatcagctctctctctgttcttacccttcctctttccttccattcataagacaaaggaatgcataagacagctttatcttggcatgtatcattgttgcatttactctttgatttaatcaaatcgtgtttgatcattcactctgtgcttgccattccaatagtgctggggatatgctgtcctataagacagacataggtctctgcttttgagagctttacaatccagtagcctccaggtcttcagcccagctctatattttataggtcctatgtctctgtgaaaatgtcctcattgctttgttctactttgttttctttgattctgccactcagactatcagatattctgtcctaacatttagcattacaattggcctttctacatattgttttgtcagtctgtatcctaccacctggctgcttcctgctcttcaagaacatcaggttagacatcagttcttctggaaaaccttacctgataaatcattttgtttcttaaatttatcttctctgggcacataccctattgcactgtaaatctctaggctattctatgactcctgccagcctgtagctatagaggtacctgggctatgtctaccttattcaccactgtagcccccaaacatagcacagtccctgacatccaacagatactcaatacctaactcctgaaacaattgcgtgagtatcatgctcttgcccatttggacagttcattgcccttgctttctggcaatctctcctaatttcatttcttccaagtccgactatcattcattttatgacagccttttttttttcagctggcaaactatgagaggctaaaacttatgcaacacacaatgaaagacaaggtcatattttatcgtctttgcctgttgcagtaaccagattagacatctttctacaagtgaggcgaatgcaagccaaccgatatctatcatgtcaaacacctgattactatgtgcggaagaaaaagagggaaccattaaagatacatggacaagcacctgcccttaaggagcttacaacattgtgggaggtctctggtttcatgtaagaaaatcgaataattaaaaatacaggcagatgcttggctttgtgcattctttataaacaatgtaggggtggcaggtggttgctaagttttcaccatatcatgcctccacaaagccattgggttgtttagactatgtttacgtacccagctttgaaaaggggctgaagaagaaatagaagatatgttgattcatggtagtgaggcataaacttttttgtttgtttgtttgttttgtttttttaattatactttaagttttagggtacatgtgcacattgtgcaggttagttacatacgtatacatgtggtgaggcataaacttttatgatgggtagaaaactttataatgtgttataagaagaaatgattctgaattggctgggagtactggctcatgcctgtaatcccagaactttgaaaggccaagatgggcagatcatctgaggtcagggtttgagaccagcctggccaacatggtgaaactccctgtctactaaaaatacaaaaattagccaagtgtggtggcaggtgcctgtaatcctagctactcgggagcctgaggcaggagagtcgcttgaatctgggacactgaggttgcagtgagctgaggtcacaccactgcactccagcctgggtgacagagcaagactctgtctcaaaaaaaataaataaattattctaaatttatccatgtccaagattatggcgtccactccttgcactactttttatctagaatgtttatttttctcttcactagaacattctgtcatctgtaacctaatcccattggggagagtatttgattatcctttcgttagtgtgacttaatgctgccaattttccaaatctagcaagagatccttggtgacattcttagtgggataccgtagtcagcaacgttcacggcagagttgctgtctctctaagcgatttggttttctttgtatgtataaggacttcctctcttacaaagaaagttgtgtcacattcgatcgatcaatttcctcctttagaagcaggcagagaatactctggacagctatgatggaataagtcacacagcgatattatctcaaattatatctgtagggtaactgcaagtcaggtatttaaggggacagaatccatccttctccccttgtggatttggttaaatgtagtagtattagcaatggcacaagtcatctaaatttatcttgaatgtgaatttgacactgatgttactctggtggtagtagcaagaacttttccccctttagaaaaagtgggctggtgaaaggagatggattatgaaagtctgttcaggattgaggcttcccgcatacccaggaggtggagaatccctattgaattaaaattcaaaatgcatctgtctgttctttcccttacaaaaattcacttttgccaatgtttatttgcatggtttgattttctgcttgtccatatgcccttctgtccatacaagtatatctgtgacagtgatgggcagccccatctgtcactcaggaatggatggcagtggtgatggttggttggtattgatagccaagtacttactacagctgagctttctggtcttgactgtgtattatagttatgcaagaggttatcacggggaaaaatggatgaacggtgcccaagatcaccttctacattttttgaaactttctgtataattatatctctatgattatttgaaaataaaaaattaacaataatggcagtcataggctaggctctgggttcagaattgggttggtacaaatttcttcatggaaccatcatgacctgagataattttcttagcgtctcagagcctattatttatgaaatgaagataaagtcggtgcccgtatcatcgggctgtgggttgcattgatggaagttctatttatagaacatttagggcagtggcaagcatgtggtttaagcccttctaattgtattattgttattatcaagaatgttataagtaacactatcatcattaacgtgattaatctacctgggttctggatcttagggtggcaggaacatggtcttgtgcctttttgacaacctctaattttgcctaggatactaaaagactttgtcagaatgtctcaaaaatattttatggtgaattgttccaccataactctcacaaatatcacctcttatctcagcccacaaaaaaaggtcaattatagataaaggaaaggacctcattgttgccgaaagacttagatatgaggtctggatttgcacttattcacttcaagactttatgtttccttatctgtgaagtgggtgtgctgaaaatgagtttattactctagctcctgtggagatgaagtgagattatatatatatatatatatatatatatatatatatatatatatatttatatatatatatatttatatatatatatatttatatatatatatatttatatatatatatatagtgactaacattgtctgatacttagaaggtgctggaagaataccagctgttctggctgttagtttgtattaataacaggcaataatacggcatttgaagcaatttcgcaaacagacaggtgaagccctacgcagcatgcctttccagcgcgaaatgcttcagtgcaatgttaggatattctaatggggaaacttttttcagtaatgcagggcaacggtggatggttttgaccttgctctcagtgccccgaggtgctgagtgagtcagaacatgtctcagtactactaaaaatgaagagactagcttgggattcattttttattcaacaaaacattttgaatgcttttgtacatgtgtgtgtgtgctcgcatgtgtgtgcacctcagacactctttgagatgattgaggcaacagtgatggaccaaaaaaaaaaaaaaaaggaaaccagacaaggttcctatactcatagagttcacagtccagttggagatggacaccaaaatgtgtatataatgtcatactttgacagaggttttcagtggcaagacagggtcctctgagaccctggaaaagtgagaaactccatcttcctaagtgcttgatgccgttggttgggaacttcacttgttctggatgtcgctcattttttaagggctaagcacatatttccctttggaattatcacctcagaagtggccatatccaggtctctgacttgtacagagtaccataaatattttattgtcagtgacttttaaagagttgagaaaaacagcctctccattgccttctgtaactccaaatggaaaatcaggatggaacattttgcaaacatgacacctcctcactgcaagtcgaccgcccactcggttggcttgtgtttctgaggctggtgtttgtcagccatggcaagatggcttccatcctctctctgtgcttccctactgagccggagaagtgaaatgagacaagtagctttgctggaatctgtaacatggattctgtcatctttgttgtttgttggattttatgaattatggcttcagcacaactttagagttctttgttcaagagataattttctggccaggtgcagtggctcatgcctgtaatccgagcactttgggaggctgaggtgagtggatcacaaggtcaggaggttgagaccatcctgtctaacatggtgaaacaccatctctgctaaaaatacaaaaagatagccgggcatggtgacgggtacctgtagtcccagctacttgggaggctgaggcaggagaactgcttgaacccaggaggcggagtttgcagtgagcagagatcgccccactgcactccagcctgggtgacagagcaagactctgtctcaaaaaaaaaaaaaaaaaaaaaaaaaaaaaaaaatttctgtaagctggcatagttaccagaacaaaagtttatatgtttatctaaatgaggtcagatctgaattcatctccaagtatttaagaatatacaatgtaggattctgacagatttgggtacctggcactaacaagttgtgtgagcatgagcaagtaatcccacctagcttgaaaaagaagataaaaatatgcggtgtgttggattcttgttaaatgaggtaatgtaggcaaagctactttattgaattttgtatgcttggtgcttagaacaataatcagttcataattggtgtgcaagaaaagatttcttttcctcgttaccagacatcgtcatcaccatcaccattattaccatcaccttcatcatcatcatcatcatcatcatcaccaccaccaccatctttgcttttatcttcttatggattcagtaacaagaattcttcaataagactcataataagattgtgttaaaattcgggttctttcccttactaatgtacgagatccatgtgttggaaagtgttttccatttgtttagcacctcagttttcttatctgccaaaggtaccataatgaggtatgtgatctgccaaaggtaccataatgagtttagtattcactgaagtaggttagagtccaacacacatcccttcttcctgggttctccagaggaagaacttcactggactggaaggaggatcagttttatccccacagtgggacatatgtgcatacaggactttctagattataaaatacattccagtagatttttccctctaaagcatcgtaagagtctcactgtgaagaataatatatattactatttatattttatgaataaggaaactgggtcacataaaggttgaatgacttgccaatagtttcaccattatgctcttgatgcctcaatatttgactttgatttcatagtcacagcattaaaaggttagatagtaacactagaaattacctggcctatcatagtgtttttccatttatttatttttaccccaattcataaaagattttacactctgaacccattcctccacataaagttttcatgaaacaatataaactcttaactattttattcttctctcatgtgtgtagattatttcatttaaagaatgttggtatgatgatcccctacatgggtcttacagcctaagagatcagactgacagaataaaaaacacagaacatttttctccaggattgtgtatcagaactatctggggcaacttttgacagtgcccatccctggatcccaccctcagagattctgaggcagtaggtctggtgtgaaggccttggaacgtgattttttttttctttctttcttttttttttttttttgagacggagtcttgctgtgtcacccaggctggagtgcagtggcgcgatcttggctcgctgcaagctccgcctcccgggttcacgccattcttctgcctcaacctcccaagtagctgggactacaggcgcccaccaccacgcctggctaattgttggtaattttagtagagacgcggtttcaccgtgttagccaggacggtctcgatgtcctgacgtcgtgatccgcccgcctcggtcttccaaagtgctgggattacaggcatgagccacggcgcccggccggaatctgttatttttaaaagaatacataaggagctcatgctccactgactaaggacccatgttctgttgcatctatctgattgtttccagctgaaactctttaactctttgtctatttaagtttttttttcttttctttttgagatggagtctcaccctatcacccaggctggagtgcagtgatgcaatcttggatcactgcacactccacctcccgggttcaagcgattctcgtgcctcagcctccaaagtagctgggattacaggcacctgccacaatgcctggataatttttgtatttttcgtagagatggagttttagcaggttggcctcaaagtcctgacctcaagcgatccgcacgcctcggccttcctaagtgctgggattacaagcgtgagccaccgcgcccggccagttgttttgttgttgtttgtttttgagtattttctgcgttattccctaggacattaatgctttcaccagggaattgtccgtcttggtcttgtctctctttccaaggttgaaggacagaagttggcctctcagttgaggacaagagcttatggtttgtgcgaatggctgctgtcctcgcatactgagctggagtcttgtgagacagggcctcttgtcctctgtgtttatgtggttagagaggggagctgacacatccttttaaagaaactgaaagggctgcttgttttaactctcactctgtgatgcattgcagagatccccaaggtatgattggaaatggaaacgtaaggacgggcacaaatactatgtatccagattttctttccaaccttgtagagctgggaattaaaaagaaaaacctcgcccaggggccacctgaactagaacctgcaaaacagacaagcagaaaggttgaattcttccaggcggtctcttccaccctcacctcctcctctgttatacaatttaattacaactttattcacttcagaaaccccatccattccttccagtaggggaagatctctctttccatagcaaggagccttggtgataagcagctatctgtaggaacggtgcatgggactctcaaaacctctcccttgacaagcaagaaagacatgagcaaataataactgaaattattttgacatttcactctggttgttgtagttttcataataaaggaagaacaaagtacttgcagctttaaataaagaggctgcctttggcattgatgtgggatttcactggggaattttttgtatgagttcttgtttttgctcactgggagagaaaagaaaacgataagccatgaaaagacaaaagtccaaggaaaggagaaagcaagacccctgtactttttcttgatagcatttgtcacccctggaatattgcggtcatcttagtatttattttttgtttcttgaagtctgctgctgcacttgactgtaaggtctatagggacaaagatggttttggattttgcttaccgttgcattaaatgtgaatgaatgaattcgtttacataatgtgtactaggagccaagccctgtgtgtgtgtgtgtgtgtgtgtgtgtgtgtgtgtgtgtgtctgtgtctgtgtctgtgtgtggtttttggtgatgtgatttttaattagatccttacaataatatggtgaagctactcatcattggtcccattaaacagaagcaaaaactagtgcttggagtatcacaataacttgtctaagattacacagccagtctgcaaaagagctggatttcaaaatcttccaagtcatcatcagttatggtatttttaagatcgatttgcagttaaccacacagctttattacaaattcatgctctcttgatgtactcacagtatttttcaaaatttacctattgctatctctctatctctttaaacttttttcatccatcctctgtctcttcccttttatccctgaatgtttgccctcccctcttaagaaaaaataagatagtagcaagctccctgctggattttataactttgcataccatatatttagtttagtaatgaaaaattccagctccaggcgatgcatagaatcgcatttctaatgttttttaaacagctattaatgtggtcgagcagtgggttttttttttttttcccttcctcctctatataatcatctgctcagtggtgcgctgtgaaactgagagtaggagccagaggaggagcaagctgtgattgatgggccaggccttcctggcagaaaaagtgccatctgggttggttttgggagcagtcagatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcaggtatttttgtttttttttccatttaatctttcactcaaaattgcgatttgaatgaagctgaaagcttttcttgtgttaagtccgtgctgtcggtgacacgtagcttgctgcttgaatcatgcccggggaaaggagaggagttttggtgaagagagtgtgtgtgtgtatgtgtgtctgtgtgtgtgtgtgtgtgtgtgtgggcgcgcgcgcacgcgcgcacgcgcgctttctgcttgatgtgtggaactgagctgatcttagaaccagcaggttaatggtgtccttttgcatttttcttctttgtttgaatgcccctagggcatgatgcagtttagctcaattcacttctgcacaagagggtttctctgaatatgcgcgatttcttgccagagaagtggtgtagaccatgctcctaaactaaagtaaaacaaactgtcagcaagactgaaaactgcaagcaaccatcaagaatggatagttttcctccagtgagtccatgctggtggggggtcccactgcaggagccgctgctttcctgggctgtgtgggcatatgtgatcagctggcttattaggttttgacaattcctgtgcatgtcttcattataagggttgagttaaggccagaggaggttctccacagcaggaaataaactggggacaagtaaattccagatgcagaaagggagggtgtgctcaagaagtttgactataaaggtggggaaatacaggtgtgtgagtgtgcacacacacatacccacacaggaaaatgcttgcctattttaaagtccacctggacggctacgaaagctggtactttgccttctcagtgaaagtcaggtagttacatggaaaagaatagacccatttcctgttcggccacttaaagattctttttcagttgaaatacggtttaccttcaattttgagccaaaaggttttgcaaaccctgactggctaccactcttgtttctcttgttagtttctcaaaactactttattaaaccactcagggcaacgaatgggagaagggcaatgtcttggggaaaaaacaacgacaacaacaaaactctctcatcttattttctctctgactctgtctcctgagtccacttcagagagaaaattcagggttcaggatatttcagggaccaaagaaattctctgagcatcagaagagtggccctcttattgcatgcatacaagagtcaacacactatgctaatagtcagattacagtgtttgtcttaaaatagcaatgatagccaggctatttcatgcttcagtaaaatatttaaattgaaatgacttttttttttgcttttatgaatcagacttggttgcattttaataatccttttgctcttggtaactggagtgaaagctacacgttggggtgtcttaagtaatgacaggtttccatcatcctgctgtcgttgagttgctctcgttgactgagaggtttggtgactgaggacaaggaagtttcttctctgtttatcctaataaatgttgtttatttcaagcttctagtcagttgtgcagcagcaatagtgggtcttaaagcgtgagatcttggccttctttcatcctccttttgtgtattgagcaacaactcaagaaagtccaggcactgaaattaaacgttaagtttgcaaaagctcctgaagcatttgcttgatgatgtggggaacacttgtgaggcagatcatcctgctcatcaactaggaacacccacaagcaccctgactctgcagatatcagaagctctctctgatcattccacttatttagggaaaggtgggggtttggcattggagtagaagaaagaaggcagcttctgcaaatgagggaatgtctagccagaatgctccaaataattttgcctgtcactgtcccctacatgaagttggcttcagcttccaacccaggagcctgttcgcgtgcctaggatttgctgtgacctggagtggaaaaggtgcccttaatgtcagtgtatttttccagaaaatacatttcagccaagctaagaatccaggaatgtcactagggaggaaacaaagacatctctggagccatttgaaggtgaaaaataattccataggaagtacaatggtcttaattaaatattagctgtaattagcctaaagtgcaaatgttgggaatattaattagggtctctctggaacggctgtcagtgttaataagtaactgtagggggtcccaccaacatctgtttgagaactccaggtacaggatgaaatctggagtcccatgttcctggatgctaactgcaggctccttggctaccatggactcagtccctagagcatggtgctctgtgtttgccagaattgcacaactcatggtagaggtgggtggcttgctttggcaccagtggtgcccccagctggcccttgcctttcctcggatagcctcaaggcatttcaaagtcaggcgtcaggcttgaggtagtgcagaagtttcccaggctgctgccccactcctttcgaatggtcacccacccaacctggccattggaattgctggcatatttgaatcaaataccctagtccctggcttcctcacagggagtaacacaccaacagctaaacacaggtccatggtgtgtgtgatagagagggaactgcttatttaaaaatgggaagtggacaggcgcggtggctcatgtctgtaatcccagcactttgggaggacaaggcagatggatcacttgaggccagcagttcgggaccagcctggccaacagtaaaacgccgtctctactaaaaatacaaaaaattagccagtcatcatggcgggtgcctgtaatcctagctactcaggaggctgaggcaggagaatcacttgaacctcggaggcggaggttgcagtgagccgagagcctaccattgcactccagcttgggtaacaggagcaaaactctgtgtcaaaaaaataaaaataaaaataatgaatgaatgaatgaatgaatgaagtgaactccccaccaggtgattctcttgctagatgagaaatgccttggtttaactcttggcttccctaacaactacctgtgactgtggcctcgaataattatttcccagctttggtctgcagcatctttgatgacaaggtaaattgagattagagatgcattgcatgaaaagtagggattctggaccttggcactattaacatttggggcgggacagtcttttgtggttcaaggtagtcgtatactctgtaagatgtttagcagcattcctggcctccacccactagatggcagtagcacatcctccctcatttgtgacaaaactgtctccagtcattgcctaatgtcctgtggggagcaatcacacctctgtaagaactaccggtatgaggcgcccagcacagtgcctgccacctattaggttttcttctgaggaccagtgaggagaaggggctgcttttcatggaagtctgaggccatcatgaaccttctgctcataagcccacttatgcagatttaaagcctgtgtgcctgtgagtttacaggtcaaagatctgcggatggaaagtaaattccccaaaagattctgacccactgtttttgcaccattttcaatattgccagtctccaagtctagctatcacccctctttggtttggagagtatacaggccctttctctctctttctacttcactgcctgctttatttcctgcccaaactacttatgcaataatggcttcttaactggtgatcccatatctaatgacattctgccacagctattagaaaacattttccacaaaggaccagatgatagatcattcagtcttggtgggctgggcagtctctgtcacagctatccaactctgcctttgtagtacaaaagcggctacagacagtaaacaaatgagcatgggtgtgttccaataaaactttatttacaaaaacaaaatttgggccaggtttgcctcatgagtcgtttgctaggtcctctcttcatccccctaccctatctcctgctgccagactaggctttacagagcccagaggtcatttttccagcacatattcacttggcaaacatttataaatgtccactttgcagctagtatgctgttggaccatggagatgggacagggaatgtggcacagtgtcctgttttcagggagctcacagacaaataatcaggctgtggcagtgcttggtgctgtgtgagctgtggccaccagctgcagtggagcagaggggatgggcaactgaccaggtttcagcatcaaggaaagcctgctggaggagggactcttgatgcggactgaaggaagagtaaggactagttgggcaagggggtaggtgaggctttccaagctgaggggcagtaaatgtgaagacttgatggggttgagaggatggagctcttctcccttaactgaccataagcttctggaaggcatgacccttctctcttcaatacagagatagctcgaagtctacaaggagccttagctcttttgcaagaactagtaggaatgggccacttttcctgagcttgctctgcactgatgaaaagccccagggttatatatgttcctggtgaaagtatattctgctggaggtggaggagggaaacctttgtcttcatatgatcattgtctgtaccactgcttatgtggttattctgtgcttccctgtaagagtttacacaagtctacctttcacttcagagatgggccaggtagaaggttggggaggcagaaacagatctttgagcagaagctgcctctggcacagtgaatttctcatcagatgattcccaagatcccaacatttctggggcttttcatcacccatagagaagtggcatcgctatgaaatttctgtacagaaggatatgttccttgaacagcccagaaaaagaaaagatgctagtttagttataaaacagcagaagtttttttttttttttaattagtcaagacccttttggttgtaagtaacagaaaaagtagcttaaaaaatgagacaaagggtacaaagtgtcagttttgcaagacagatacattctggagatttaagtacagcatggaaacaagagttaaaaatactgtattatatactggaagtgtgctaagaggatagatcttaaattaaatctctccacacacacatacacacacacacacacacacacacaaatggagatcatgtagaagtgatggatatgctaattacctggaatgtggtcacttcacaatgtatacatatgtcaaaacatcaagttatacaccttacatgtataatttttatgttaatggtatcttagtaaagctgttaaaatatgggacatttactgacttgtgtaactacaacaaacagggatggtgctgactgcgggtaaagctggattcaacacttcaaatgacgtcactgggactcagtagaaacctctctgttcctcagtttcttctcttcattttcctctaggttggcctcacgtgtagggaggtccccttcaagtggcagttcgttgttgttgttgttgttgttgttgttgagacggaatcttgctctgtggcccaggctggagtgcagtggtgcactctcagctcactgcaacttccacctcccacattcaagtggttctcctgcctcagtctccggagtagctaagattacaggcatgtgccaccatgcccggctaatttttgtatttttagtagaggcagggtttcaccatgttgcccagtctggtctcgaactcctgacctcaagtgatccacccaccttggcctcccaaagtgctggaattacaggcatgaggcaacatgcccaccctaagtgtcagttcttggcagctccaggcttatgatgtttttacagctgcccatcaccgtggaaagagaacttcttccccaaaactacagcaaaatcccagggtgactgggactcagtggtgtgactagggcttaacgcactaacggactcactagatagatgtgcatgaacgcaaatccatgggactatctcagtgggaccatctgattggccaggctgatgtcctatggctcatctcgtagcgactgggagctgggttcaactgtatctgcaccatacaggctgaaagtgggactgtcccccaaaaggaaactggggctttgttgaagaaacaggagtggagacagaccagcagtatcactgcatgtcttctttggcttcccaaggatggacaaggttaactgctcatggatagcaactcagcctcaacataggcacaccctccatggccccagtgctatgggaaaatgttagaaagagaaagaaatgctcgtgcccttttgtttccagtggcacagacatttggcgaaatttgtctggaggagggaagagcctgatgggaatgatttacttgtaaaatgtttaaacttatcctaagcttagttctcttccaagtgtcatctttaacattctaattaaggtcccttctaaacaaatgcaccagctccgtgtgctgctctgagaacaaactttttttttttcctctcttctttctgtcatcatgtttttgctgcactcaaattgctttagagaaagaggatttcggatgttggtggcaagtactgaagagataaggagaaattctgatatttttgccctagtatcattatatgagggccaaagtcacatctaattgaccacagacaataggagaggcagctatttggtgtgcctaattgctaagtttttttcctcgctctgtctttctgactgtgtgatcccatctcctgagaccatggaaagtttagacctttgggttacaatttcttatgccgtgtgtgtgtgtgtgtgtgtgtgtgtgtgtgtgtgtgtgtgtgtgtgtgttgtggtagaactgtggaggaggaggtaaagagagagagctgtttcctgaaatggaagcatttgtattcaggtttttgttgtgtgtgtttttaaaattcttctgagttggctgtaattgtcacactgcctgttttgcctagatctgaagaatgaattgttatataatactctgtgctcataaaaaaataaggcagggagggagaggcattgactaatgagactgagagttaaatccaatatttttcagaaatgcttaaaatggggatgtcagagaggacagtctttgtccaaattaggccctgaatttgtatcagctgcttcattttggcactggggacatcatacacgcatacacacacacagacacacacacacacacacacacaacataacacacaaccacacagacactgggaccattaaaaggatactccctattcccattatgtgagccaagtcacataaaactttgattaaattcaaatgcttacataaattgtctctcctctcaagaacacacacgttcaatttagtctctcttggcactttaagtatcaaatcaaggttctgctgtcactgcagacaactaaatgctcacagcttccaaaatgggaatgaaataaaaaggatctgccaaaaaaaaaaaaaaatcaatctagtaaagccacagaccctcatgtctttgaatattaggctgggtggcttggaaaaagcgactttatctttatctttccaagcctcggtttctgcatctgtaaaatggggagaagtgatggttactgtttccttatagggtctggtgaagatgacctgagattggtccatctcaggctggtggcaccatggtgacccctagaaagtacgcggggcacgatcgtcctgggatctgggaggaaggtttctgcatggtggctcctcatgacgttctctccctctctgcacctttttgatttttcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacagtaagtggacgtgtttgctacgggtgggaggttatggggaggcgcccccagccctggtaatggcagcgggggtgcacccccatctacccagggactctgggaaacagatcagtccctaagcccaccctcatcataccagcttcctgaagtttacctcatttccatgcattcattcttagcgttcatttaaatcaacggattattaattaatttcatttatttgtaaaggggcacatttatcaattttctattcctatagttttgcctttctagaatgtcatcccaatgaaatctcatttttttggaaaaaaaaaatttgatgtaagataatttttcttcaagtcttacggaggctgggtgtggtggctcatgcctgtgatcccagcactttgggaggccgagatgggagagtcgtttgaagacaggagttcgagaatagcctgggcaacaaagtgagacctcatctctacaagaaatttaaaatttagctgagtgtcatggtgcatgcctgtagtcccagctacttgggagactgaggtgggaggatggcttggggccaggagtttgaggctgcagtgagctaagattgctccactgaactccagcctaggtcacagagtgaaactctgtctctaaataaacaaaaataaagtctttgtggaattataatttacataccttaaaattagtatatttttaggtgtacagttcactgatttttagcatatttacggagttgtgcgatgattgccggatgcatctaatttcggaacatttccatcagcctaaatacaaatcttgtgcccctttgcagccactcctcattcatacctcagagctctgaacctcgcttctttaccttagcctaatacatttgagattcatccaggttgcggtgtttgtccctggtttcttcatttttattgctggaccaaagggcaggggctagaaagaggcagggtgagagaattttgatgaataagggaactgtcctgtatcttaatggtgacggttacatgactttatacgccataaagagtaaattttattgcgtacaaatgatgaaatggattagaaacaggcatgtaaacagaaacattttatcatcactgtaaatgaaaactggtgttttgatcattaatcaaatataactctaaatgaaaatatttatcataaaattaaataatgttcatttgtgtgccacctaaagtaatcatgcataccacaaaacctgtatggaacatgcatttgggaacctttttctgcagaattctttagaagcttgggaaccccaatcctgtcgtctggaacattttttgagtgtaaggcaattctgcctcttcgtcctgtcccaagacctcaggaaagcaagtatttgtgaaggagtttatggctttgaagcatgatacatttcctgtgataaaagaaaacactgactaactttgctacttgccacctcattcatttggaggctagttttgacgttttgtttttgtttttgtttttgtttttttgagatggggtctcactctgttgcccaggctggagtgcggtggcgcgatctcggctcactgcaagctccacctcccaggttcacgccattctcctgcctcagtctcccgagtagctgggactacaggcacccgccaccatgtccggctaattttttgtatttttggtagagacgggatttcactgtgttatccaggatgatctcaatctcctgacctcgcgatctgcctgtctcggcctcccaaagtgctgggattacaggcgtgagccaccgcgcccggcctagttttgaagattttttaaaaaaatggtatacattctgaaatttttagttgccttcctccctttttaatttattgtggtaaaatacatataacataaaacttaaccattttaatcctgtacacatttcaatagcattcagtgtattcacaatgtagtgcaaaaccaccaccattatctagtttgagaatgttcctagcaccccaaaaggaaaccccatacccactaagcagacactccccattctccctctccccggcccctggcaaccaccaatctgccttggagatagctttttgtgtctggcttctttctcttaacacgatgttgtctaggttcattcatgtggagtaccccactgtatggatagaccgtgtttatttattcattagtccattgatggatatttgggttgtctccacattctggttcttctgaacactcctgctgccgacttttttgtatttagttgctgtgccttaggcatgggccttttaaatgagtttgctggttcagcaggtgtttgttgcttttgcgctgactaccaggtagtagtgatggggatgttgtttactgtttgttggctattttgtgacaattaatagtagtaatgcctggataggttattttcagattttgaaaaaagatccaatcagacattatttattaagctaactgctgtggaaattttacgtattcatttatttattcacaaatatttattaagcttctattagggccaggattcatactagctgccatggttgaacaaaacaaaatgatctttacctcttgtaacttagtatgagaggcagaaactgagcatgtggcaaatagcatgtgtgatagatgtcttaaggaaaatatgggtaccgtaggaaaattaaaaaagaacagaggtgctacctgcaaacgtgtagtctgagagcatttcttcaaggagatgatgcttaaggtggtaagacaaagcagcccaggcagagggaataccacagtcagaggtcttaaagttggaaagatctgggctcactcaaagtcctaagaagaggccagtatgttttgggcatgatgaaggggatttggaggtgatgtggcaaaagatgaaccgggaggaattagcagggatttgacatcctacagacctggtgggtccaataaggagttgaaattccacgttataagcaatgggaaaccattaaaaagagtttaagccagaagagttatgaaatgagacataaaaagaaagggttagtgatgcctagcttaaaggaaatttaatctagttggggagctgagatgctccacatctttgccctgcaaaaagaacactttagagatcaacacaattgaatttaaatagcgtgttgggtgtccacagtgccccaggcactgcagcaagataatctgatgtgcagacaagctctctttccttggagagccttaggagaatataggatttgttttctgttaattatgataacgtgccaaattctagcatatagattttcacaggttttatctatcataatgacagtaggagaaaacattttcaaaatcatagtcagagggttatacctttcagagacttctggttacaggaaagagaaaactcagtaggaagcatgttggcccatacaataaaaagtccaggcggagggtggacacagcctggtttttggaacgtgtccatcagcttctaatgggaaaccatcctgagttggcttcctcgtcctcacctcagctctctggctctgtcctgcaagttcaggctccagtcaccacctgtgaaaagctcttggattcatcccatataagccctctcgtgggaatcaatctccattcctggcttgtgtggtgttatcttcattcagtggctgaggctggtactgagtgtcccagccctggggtcactgaggagcttcatatccaaatacatggaatgaagaccatttcatcagagttcatgatgagatgccttcagaataaatcattaaagaaacgaagtagacagaatcttgtccgagctaaaggtagcatggtgaaccttttgtacaaagaagcttgaattggtgttaatcaagagtagggagtgaagagaaagacaaggacagaacattggagagctcacggggtggggtttgaaggaagaggaactattgagtaagacatcaatgggatgttcagattgggcattcaaccagttgaatgttgggctatacagcctggagggtataaactgagaagacattattgaagtgacagtttggatgtctttaaagacctagaagacaatagttttgctagagtagtggagagagatgcagaagggacaagagttgaggaataactgtgatatgttggagtgggtgggcattgcccgttataaatatttggagtgatgaggagaaagaagagattgcatctgagaagcaaagaagtcagagaaagcagttggtaggatagttgatttagattcaactaatttatgccaacaaggtccctacgtggggcacaaaagacaggaagcaagagatagggaataatggtgcaggaaagaaagtgatgaagtgttttataggcgataagaaggaataggatcaagagtattcagaaatagtaggtagtctaggaaaaaagaaaccactttttaacagctttgttgacatacaataaactgtatatatttaaagtatacactttgatacatttttacaaatgtacctgcatgcacaaccattactgctatccagataatgaatctgtccattatctcaaagtcttttcttgctcttttttgatcctcccctcctcctccttgcctcatccccagggaaccagtgggtctgcttcttttgctatagcttaatttgcagtttctagaattttatatcagtaacctcaaacattatgtgctctctttgtctggcttcttttactcagtatcattatttttagattcatccatattgttgcatgtggttgtagctccttccttttcattgctgagtactgtttctgcatggatatgccacagtttatttctccatttacctacacatgggcatttgggttgtttttcattttgggtaatggagaaataaatctgctgacatttggaagtacttcaattttgaaacagaagagaaggaagggtgaatgtgtgaggatgcagagaaattttcaagtcaagagataatgtgaggagttccatctacattgccttcattttttccatgaatggaggcagcatcatcaaaggaaggattcctgaacttgggcaaacatgtcagaaatctgccttagataattcctagagtatttgaatggcaatggatgcccgaatttggagaatgtaaatgtatggtggaccggttagctgtctactctgtcttctccagcaatgtttggatggtacacactcttagaggtaggattttaaaggaaagacagccattaggggctgaagcaggtgggctttggggctgatcctgaaggaagttttaagacttatattctgaactggtattgggtaagtgcgggaatcataaaggggctgtctcgttttttgttacaaacaattacatctgtatactcatctctctttggccaaaaaggagatgtgacttttcagttatcctttcctgatctacaccagcagaacgtggtctatgacaagtttacttcaaattgtctctgcctcctcctacatttatggggtgtaccttgtcttcactccaggttctgaatttcctgtggaacgaatttaacctcaaagtgggtcagaactatggttctccccaccctatatccatgaccctgtatttgcacaaaaagttactattgtgagatacctaggtcattccccataggatagtgctgtacctggaatagctctaactcttctttgacatatgtatccacgatgcttaatatcattctaaggacatcgtagaggccattatttctttgagaaactaagtacttttgggtaagagaaaccagccatccatctggtggcctccaagaacatctaatatatgcacatgatttaacacaaagtgcagaatctgtaaaagggaaggaggatgcacccagagctcccaaccagagctcagtaaaatgcagacagaaaagacttaccaggtcatccttttagttccccacaggctgagatgagtccctgcaggcctttttttctgctgaatttctatttcatgtaggcctccaaacatatcacggatcacattgctgacagagccaatactgtattatgttagatactgttcctgacaaggtattttactcttgacatattatcattagagatttgcaagtggtgaattctccatgtatctccaacagcaacttaacttctatttttaacgcttctgcagtctgttgaaacggctcccaccactttcccactagctctaggccctgattggagaaggaatgtgggtgccccagctaggttcctgagctggaggctctactgacagggaaaagaactatttagagagccaggttcttctttggcctcagccgcttcccactgaagtgttaactgcgcctccaaatttccttaatacttttaggaagataaggtattggttggtgatggtgtcctgttcttaaccctttccatgccagttctgattttgaagctgatggaatcactaaggtataggaaaaacttgttcagggcattccttttgactaactagctattattattatcatcatcaaagcaattcaggcttggggtttaaaaagccagacattggaaaaggatataaaatgaaaactaacatgtcctaatacccacaacccaaattcttagtctctgtgccagaaatgagttactaataccttatatttccttccagaagtgttttatgcaaatgcaagcatatgcctgcttgtcctctatctctatctttatctccctctatctctatcatctgtctctaattcaatctttatatcttataagtactcactatttccattctcaaaattacagaattgaaatctaaacacctactttggcacctgctttatatctcagagattattctgtatcatatttaggggttcagtcattattttgtgtgtgtgtgtgtgtgcatttttatgtacagaagtatcctaatgatggaatttaggttgtctctgggtttaatcttgcactgttgatatttaccatcaggctacagtacagagctaggtacaaagattgctctccatctctgtttgcctctgggtgtgaatggctaaaaggtacatggacttaagatgtggacattgatcaattaccctacagagagcttgcaccgatttgcaccctcatggacagaacctaagaaggcctgacacccacacccttgcccaacccaatgtgctagccaactcttggctcatgtccctgcggactctgtgtgtttgggtgtggctttccccctctctgacaaaagaaagtacttttagaattgttgggtgtcctggagaagaaaaattgaggtgtgctgccattgcttgaggcctcctgtggtccaaagatcatgctaggccctcttttggtcgccatcttgttttgttacatcaaccttttgaatgctgttagaatcccaccaataaagggagaaagaggttgaagatgttttgagttgggaatggtgcagttgaggtcgtcacccacatcttgtctgcctgatgttaaagtccaggctgtttccccagtctccagctgtcttctaaaataggggtacccaactcccaggccacagatcagtactggtctgtagcctgttgggaactgagctgcacagcaaaaggtgagtggtggatgagtgagcattaccactttagctctgcctcctgtcagatcaacaatggcattagattctcagagaagcgtgaaccctattgtgaactgtacatgcgagggatctagattgtgtgctccttatgagaatctaatgcttgattatctgaggtgcaaccatttcatcctgaaaccatcctccctgccccactgtgtccatggaaaaattgtcttccacaaaactggtaccaaaaattttggggactgctgccctagaggatctcttgaccaatggcttagaattctcatgaagattggtttcttcgtggctgccctctagcttagacaaacaggtcagttaaggcctggcctctggacttgacaagatttgaccctccattctgcttacaagcggaaggagctcaagctgaccattgaacctctctgctcttattttttctataactcccttcctcagctgtgacccttctccagatctcctcccttttttcttctaaacaactatcagacgatggattacagaacaacagagttcttttcctttgaggagggtttacgcctcatgtacttacattgaaagtttggcaaaataattgaaggttgccgtctaaaaatagggtgaatagttacatcgaaatgagaatcaggaaaaagtctcaaaaatcataacttttgctcattgactgtcagactatattttaagcactttccatgcacaatctcaactaatcttggccctccccaccacgtatgaagtgttatcgtcccatgttacagaagcagaatctaaggcaaatcacttactgaaggtcactgtggctgagaagcaggagtcagagctcaaaaacaggcatgtcagaccaaaattcttaagggctggaagcccagaaggcatcccccaggcatgcccagccacactggcctcttttctaaataggttgctgttgcagaaaggaattactcatttcaccctggggagggccccagcagacccaagcctgtgcaacattacagacttcgagtgtgctcttgtttgagacctgcgccttgagcaaactccaataacatgtttcggtggcttcaaaattgtcttttcggatgacagtgtgactgagctgttttgtcaataccagttctattttcctaaaattcacatttaatttgaagacatgggtactgtctcttgtttccttaggagcctgagcactatgcttctcactcccatgtattctctgcaatacatggcccttggctttcaggataaactaaagacctttattacccaatactgtgcctgttttattattttaaagaccctggtcatcaaaaactgtctagtcctggagagccaaaatgaatgatttatcccaacttaggataacttggccaggaacaggatatctctgagcatcaaagacccatgtgtttgacgttcttttttggactggggtttcagcctcggattttggcagaattggaggttgttatgacaggtgaaaaaaaatggcgttggttaaatatctttagatattatcgggagaagcagagtagaatctaggtacagagcttgacattttcattcccattctgtctgacccagagtgggaccataggcacgttacataacttctctgagcctgttcttttttatatgtgaggcttagagttgttgtgaaatcctaatacagtaatgtctatgaaggtcttagcacaatgacaaacacatagtaaacattctaccagatcgaccatcctaattatgaaataattacagtacccataatgagaaatcagagcggtctccttggttccgagttcttcattaaaaatgttttatccaggagaatacattcatcataagaattgtgaaatttcccgtttcaagtgccaaactaaaactccaattccgagatttattttaaaggtaattttgtatttaatgatttatagacaaatggttttcaatcactcatgttttagtacaaactatcagtacaagctgttcttggtctaagtctaggtcgtgggcaaacaaagtgagattcattagagaaggaaatgactgaagttttgtttttaagacccaaggacatcttgcttttgctaaatgaggaatgctcaggcatattctaagggtttgatttaatgtttccttagggggcttcactggcttatttccattgcaaatattagagccatctgacaagtttcatcgtgactttgtcctcatttggtgctttgtgcttattcacacctgtatttattgtcatcagtttacccactcaggatgactaagcagtctctatctttatttttggttaggtccttcaaacacccaaatccatcctttctgtagctcatagagactgctagacaaaggactgatgtaagtgtttgaaggacctaattccctctgcatagctgattgccccattaagcaattttattttatttatttatttatgtgagagaggggtctcactccatcacccaggctggagtgctatggcaccatcttagttcactgcagcctgaaactcctggggctccagtgatcctcctgcctcaatagcagggtactgagctcagtagctcagtactgcctcctgagtagctgggactacaggtgttttccagtgaacttagaaataggcattaatctattttgtgggcagtatttgggtcatgcattagtcaacagtcattttatgcccttaattcatggtcatatagtctttaggtgcatagtaagttcctatgaattccatgcaatttttgaattcaaggctggaaaaagaagttggctattctctgttgacagaagtttcaggaatggctcagccagaaccttgcaatgctagagctgggagagccaaagagttcatctacgctatcttctcgttgcacatatttaaaaagatcacataagttatgggttggaaacggaaggccaggcacagtggctcacatctgtaatcccagcactttgggaggccaaagcagatggatcacttgaggccagtgattcaagaccagcctggtcaacatggtgaaaccctgtctcgacacaaaaagtacaaaaattagccaggcgtggtggcgggcacttgtcatccccactgctcgggaggctgaggcagaagaattgcttgaacctgggaggcggagcttacagtgagctgagatcatgccaccacactccaccctgagtgacagaatcagactctgtctcaaaaacaacaacaacaagaagaaaaagaaaactcaaatactttcacatccaggcaagtaacatccatgcttagagagattaacttatgttggagacattggcaaaataaatttttagttttctccattaaggtaggcattacaaaattacaagcgtgatggtatgcaaccctttggtggggaccctgtagtaatttagcaaacaaatttcctgtccacaggatgtggtccctatccatccatccaatcattgctattttggattgttaaaccactattataatttcattgacatatttccactgcaaatgtttagatttctttcttcttaagaatagcagcaatttttatttttctgggttctcctgttcactactattttattcatttttgttatctgtccagcctctgaagatactgaatttacaacttctgacttaatcttggaaactcaagaggtgaatttaggctgggcatggtagctcacgcatgtaatcccagcactttgggaggctgagacgggcagatcacttgaggtcaggagttcgagaccagcctagtcaacctagtgaaaccccgtctctcctaaaaatacaaaaattagccaggcatggtggcgggcacctgtaatcccagctacttgggaggcggaggcaggagaatcacttgaatgcaggaggcggaggttgcagtgagctgagatcatgccactgcactctagcctggaaaacagagtcagactccatctcaaaaaaaaaaaaaaaagtgaatttaggaacctgaaccctttaagggagactgtatttcaggttcataaaagagacagcttggatgcttcagtgtgacagtgcagagattcatagaatgttagagcttgagatgactatcttatcttcctgcttcatttacgaatgatgctcaggttcagagacagaaagtgacctgcctgagtcacacagtgagtatcacagcagaacccaatgtaaggatgtcctaagagaaaactcccactgtaccatgcccttcctctgtccatctcctggattctacagccatttttaaaatacacatacccggggttatctctgcattgaaatagacaaagtcccaatgacactgcctttagaagcacgctgagctgtacactgtaagtctctgtttctctttgctatcctattttggttcctagccagaggtttcagccacaagtgggccttattctcacaaagacttccagacttcttaaaaaaaaaaaaaaagtcttcattttatctagttctctcctgctgctcctggtggttgtatcaatgggtctgtgtgaattcagcaatgtcatgcgttcctgccagctccagtcccaatcattacttctgggtcaggacactaaccagggggtctgggtttcttcctttgtatccccgaagaatgtggagcctgccaaattgtcaaattatagcatttgatgtagagctaggtccaagtgactgtacaatctctgcaggagttcagaagctggcttctgcccctggtagaaacataaccagactctcaagagacagtaagccagacagtctggagatccagggagatgctcatgggttctctggcttctgggccatggggagaaagtcatcaccacccagaaaataagccttcaccctgacagcagcagcagaatgtacctgggcttgaggacctgacttgcatgccatctcagtgtccttaggacagaagttccacgggcaagttctttcagcagtaaaccaaggttttcagcctgtaccactcaaaacaaaccagaccatcaggaccagttaatgtgaaggcttaaatgttgcagatttgttttgaaagtgaaaaggcaattttcttgtaaaaataaaaaaaaatatgtagagttgcaaatcatacaatccaaacaatatgggctgccctgatcttttaaaagggagaaatgtaaatgcccattctgattgtcagatgaggaacatcaaatagaaacttcttgggctgaaaggaagttacaaaagaggaagcagcgatcatttatggataacgtatggtaatgatcactagcatttagtgagctcatactgggtacccagtggaaatggtactaccagctttctgtggacaatcagattgaatttttacagcatccagaagaggcagggactataattaaccccttatggcctagatgagaaaaccagaacatagagaaatcaaggatgttgcccaaggtcacaaggctgataagggcagagatgggattcaaaggcagccacggtccactgtcttacccagtccatgctggggtcttccatgagccatgcactatgttgtgtatttcattgacataactcatcaagaaataggtgtgatcataccacgattacggatgagggaactgaggcacaggtatgaagcaaatgtaaacataggcctggcagattccaaaacccattttgtgtgattaccccgttagtagtttattttacctaaatgacattccctgctaactatttcaattatgataatatcattacaggcaaatatcttaacaatcctgcaagtctgtagagctctcaactccctcaatttatacaactaaacccacacacatccttcccatccctaacccatccccttccccagtggcatccagtggccccatagagtgaaagaggccttcataccatttggcaagctcacaagaggaagcctggatttcccagagaaacttgctacaaggaaattgctataattataacccaaattgtatttgacttctgcatttttgctttatattgttacactataatttaaatagattgttctctggccttttttagggggagaaactagctaccttttttttttttttcactaagaaaagcaacggtaggtgtagcattccaatgacaggaggtgggtttcgtcccccctcttccctctaattggcttgcaagtgggagttgggttagcagttatgccgggagttgcctggggttccaggcggtgacattcatctggtggctccacaaaaggggaagagacaacagtgggtggcgccagcttcggggagatgagccccagagagtttctgtgactccagaaggcagatgttggggacgaggggagatagggtatattaatcattggatttgggaatttttcctcttttgagacattgaagctcttgacagagaagaccagaggggacctaggaaaagggaggacgtgagttggatgcgcaccctggaatacagggcgttggccatctttctccttgcctagtctagctgtggatggggcccagagccccttagcagctcttccttttctctcttctctccagccttctccaggcttttaacatcagcagaagtagcaaggctaggagttggcaaactgtagctcgtgggccgattcctgcctgcgatgtttttgtcaataaagttttattggaacacagtcacactaactggttcacatattgcctatggctgcttttgcatgatgacagcaactttgagtaattgtgacagagctcgatggcccacagagccaaaattatgcttattgtttgaccctcaacagaaaaagtttggcaacccccgatctaggccaaagtgtacatattgttggcctgctggctgcattcaggcatcgggccattttattggactcacattaattaattgcctgcattgtaaaatggaagttttcacaaaataagctggctttgattaaaaaatggaaaaatctaacaaaacatggcagctaatgttggggatgtgtcatccgtcccctctgactatttgtcatagtcgccagcactgcctgtagggttttaccaagtgtacccttttacctgcatggactggtcctcataggcacttgagtatgatactctttcaggtcgtctgggttgtttttaataaaagatttggtatttcttactggactgatgaattacattttaaaaattctttccatcaaactggacttccctgtggaactccagaaagaaaatgaaaaatgtgtttgtgtaatgccagaatttagtgactgccagagttgttatatcagaaatacaacattttcttccaccttgaaacacccatacacatacacacagccctgcattttttaaaaaaaaaatcctttaaaattgagacctatgtcactgcagatgcttcttgacttatgatggggctatgtcccaataaatccatcacaagttgaaaatgcatttaatacacttcccctactgaacatcatcacttagcctagcacaacttaaagatacacagaacacttgtatgagcctacagatgggcaaaatcatctaacacaaagcctcttttatactgaagtgtcaaatatctcatgcactttattatgtactgtactgaaaggaaaaacagaatggttgtatgggcactcaaagcatgatttctactgaatgtgtattgtttccacatcattaagttgaaatatcgtaagttaggaatcatctgtactgaccttgatttaaacaaaagcaggattagtaaatactacattcttcttcagtcaaagaatgagtttctcagttgttattattaatagagcaagtaataatggtgttgggcaatatattaatgatttaagtcaattaattctaaaaccaatggtgggcgatgttacctcattttaaagataaggaaaagagactctaaacggttgtgtaaattgttccaaatagtggcaccaggaagtgatagacatggaactcagatccagccctgattcatgtcaaaggtcccaacgttttttttcttttttttttttttttggacatgcagtttcactcttgttgcccaggctggagtgcagtggctcgatctcggctcactgcagcctccacctcccaggttcaggcgattctcctgcctcagcctcctgaatagctgggattacaggcacccatcaccacacccagttaatttttttttttgtatttttagtagagatggggtttcaccatgttagccaggctggtctcgaactcctggcctcaggtgatccgcccgtctcagcctaccaaagtgctgggattacaggcatgaaccacagtgcacggccaccacagcaactctttaaacactgaggacacacaatagagccaatgattaactaaaataggcaactgatgcctttctctgaagcttacgtgtagaatacggtaagccccaggataacttcccctgtagctagaataactgatcccaggaagagcccctggaagcccgattcgatccactgaaagtcagttttgggtaaagtcgttagtgcgtcttctgttgttctcagcaaatcttcagacaattttttcaccaggctcagcagagggagaactaagtctaatgtatttagccgggggaatgacaggtttccttttcacagtaagggttcctaggataggagactatccactcgtagcagaagaaaatcctaatgagcaggatccaggttttagggggcccttaattctaacacacagttcaccctgggctgctcaaacgtcttgacttgccccgctatgtgtgtgtgtggctttaggaagccctgcgattttccttctttagctcgaatgtcaagcgctgcaggctttctgagaattcagtgtcctgacactggggctgagcccttggtaatgacactgtagacacgaggtaattacagctctgttaactcccaagtcaggctaagtggacctctgattattattctgagtataataggagcataactaacattgaagggaaattgtacttctctcttttattaaccgcttttatattcccttgtgcatggctatgatgctatgaaatctccttaaatgtgatattcctcaatataatacaataataatgcacacaccgtaatgtattggattactttgcaaacagcccttatgaaattgcatttcccatcatttccctgggccagctcagggctgctgggcttacgggccctttctgtagctgggagcctggaatctgccttcacggtcacttagggtttcatggatgtgagcaattggtccacaccatttttattcacagcgaggatgttggccaaccaagtttccagacatctcgctggacattgcgactcagagatgcaaacagtgtttgatacctcagcatagtttgaaaataaactgggctagatggtgtcaggaaggaagctagatacagggaagggaggccttccatgctggaattaaattgtgaagtcttttccactgactttgctggagagtctatcagatctttgttcctttgtaaactctttcctgacaccacctcaaaactagagttggttcttcctttgtatgttttatatgttttgaaaatccacccttagtttggcatcccaaaatacttactgaactcctactatgtatcacacatacattaatctactaaatacacatgaacaattttacaaccacttaaaatttaatatttggcataaagctataaactttttgagggtaccactgtgccttattcatcacttttattctcagtgttaggcaaagtgcctggaacaaagtagatactcaataattgtgtattgttcatttattcctgaatatttcttgggttcttactatttgagaggcgcagaactgggccttggagatacaagagtgaataagacagacatagcttctccttcaaggaatgtacagtctaccgtaacacagaatacacacacacgtcactcacacagttgaatgcagccagccatctgtatccaccaggttcgacatcccatggaaataagaaaacactgtttcttccatctgcaattggttgaatctgtggatgtggatctcgtggaaaggagagctgactgtaattacatttgcaaaaacttctgtgaaggaaaggtagagggtgatgtgcaaacaagcaacagggagacataaatcaaagcggagatgcattcaagacttccttaaagaagtgacttttaacatgaaaattagaggctgggcgcggtggctcatgcctgtattcccagtactttgggaggccaaggtgggtggatctcttgaggcaaggagttcaagaccagcctggccaaaatggtaaaaccctgtgtctactaaaaatacaaaaattagccaggtgtggtgctgcacacctgtaatctcagctactcaggaggctgagacaagagaatcgcttgaactcaggaggcggaggttgcagtgagccaagatggcaccactgcactccagcctgggcaacacagtgagacttcgtctcaaaaaaataataataattaataaataaaagaaagacatgcagagaaaggtgggtggatgtcctgggtaggacagacagcagatgtggaaacaagatgcaggggcgtgtggaagccagctcttaatggcctgtgattgtcgattgtatatgtctctttccaacaggacagggatgccatggtagtagcttgttacctccagggtgagagtatttacactatgggcattggcaatgctacagatgagggcttttctgtctgcttttctggagagctggttgttgatcagttaccagcactccagtgacagaaaggaagttggcatattcctgtgacaggatgaatatcagtgtagctgtgtggacgggcagggggatggtggcccaagttgaggataaacaggtgagcaagaaacactcatacagagccctgctggcctcatctgggggctttgtaccatgggaggccattgaaggattttaagcagaaagaatcccatcattaggtttgattttgggaatgatctgaccaccatgtggacagtggattggagaaaagcaataatggtgttgggaagtggcagaaaggactgccagtaagctcttgccatgggctggatgagagatgttgataggaactagaatggtctggaacatgggttggagtcaatatcaaatgaccaaataatctgccagagctctctgtaatatacagtattcacacctgtggacttttgtgacaatttgggacggtatagtcccttgtaatttaattctgagagtgaccattgaggatgtgatgatgctctctttacagtgaggaaactgaggcgtggtcagttgatgtgactcagtgtgttccctgaggtcatagctgaacaagtctgacttagtaatatgtctgactctagacctacacttataaccacaacttcacactctttttgctgccaccttcttctaaggggctggaagaatggagatgccactgagctgggggtgaagacatcgtaaaaagatctacctggttctatgagatgcatccatcctgaccttgccaagggaagtaggaatcaggaaatggtggcttctaacgtgatttcatccaggcccttatgcttgggtccatctcaggaatagtgtttggaattaacgcaggagccagagactaagcaaaccccgcctccaccccagtgcagatttcagttgaatgcagactagagcctttgaaaattatgcattggaaaacaattctggataaattaatttccatcatacataatgcatgaggggaaatccgtggtatttttaaacaatggaaatgagagaatctgccttttgggcattgatcccaattaaatttatttcagcaaacatttatcaacacctactgtgtgccaggttcttactggaaaacagagatgagtcagacattgtctgtgcccggaaagagtgagaaatcaatggaggtacccgcagagtgatcagctctgggttagaccttgagactgggagacaaagagttgtgagtattgccctggagggacatacatcctagtagaggagaacgaggacctgccagaagatctgagagtgagagtttgttgaggaaggctatctcgtgcctgggcttcacttgaatggttttctttcatgagtccttccgccatcaataagatccttatttaaagcctcctattgtccagcaatggtatgtgctgtccatctgccccattagcccatagctgctactattatgctacttttcctatggtgtccactgttattactgccacaactacctcaacttactgttgaggaaaatgtaattctcctcaacttctattactattatagtgttgctgttattttatttaatgatagatcatacattcgaaattatttgttgagtgcttactgtgtaactggcaccgaagattgaggaacagataaaaaatagctatggtttcttcgtttagaatgttatcttgtaggagagagagatggaaacaaataaacaatgtaactaaataattacaaattgtaatgtttgcttcagttatgcattgctgcctaacaaactaccccaaacaaacattttatttacttacaattctatgcttcaggtatttgggtgaagtttagctgtagagatcagcttggtacatataccacttggaactggggagtaagttccaaggtttcccacagatgtctggaacttggtgattgtctgtacaacacatctcctcccccgcacccccacccccaccccgccactcaatctctccacaagactagcttgagcttcctcacagcatggagttctatggtcaatgagactttcatatgggcatcatcttggcatgtacacacttcagtggtggctgaattcgaaaaaggtgtgtctcaagaaatgagagtagaagctgcatatctgataaagctcagccttggcatttgctatgtgctatgtctgcctcagtctgttgattaaaataaggtcatctcagattcaaggagaggggaaaagactccacctttgactaggagatatgacaaagaatgtgaaaccgtcttgagtccaccatgatactttttgaagaaaacacatattaggttgaaaaagagaagattaaggagggagggacatgagatcagggaagccttctctgaggaagggtcggttaagctgtgttctgaaggatgggagagtccagcaagagaagacagtgggagcagcattccaggaagagtgaagagtatgtgcaaagccaggtgtccctcatctctctctattcccagtgcagcttcctcaccactccccaaccaaataggagtctcttcttgtaggtggaacacgggataatataaagagcgtatttttgcacatctgagaagcccaggtgacatattgtccatgatctgaagcaacagataatgtgtttcctcatgtatttcccaatgggatcacccaaagtaacatgcttaaatggatgagttgtaatcttctacatagaggtgatgccaccaggcattggtgatccagataaatgaaatgcaggaataaggataccgagactgtttctggccacaaaggaccaggcagagtagtctattgcttggcgaccaagtgcatgatagcactgggcttcctgcttctgccctccccagtgaacttcagatgaggcttgggagatgaaagacgagagaggagtcattatcagaatggtaagaatatagcatccagatagatgagaagagacaaaaagataactccgtccccatactggcttatttctcctttatggagaaggcagccccttggaggtaggcatttcctgggttcaaatcccaacgttgccctttattcactgcatgactttgggaaagctattgaacctcactaagccctaaagcatagaaggtgccctataaattgtagctgccactacttctattattatcatgtatgtcattattgctactgctttgcagaaagacatgtgcctcattggtggtgggattcttctaacccccgtctcctcctttcaaaggctcactctgctactttagagttatcttttatagtgtactcccaagcttgcgatgttgcttccctgcctgtaccattttgttttctccagatctcgctgtttccctcgctggaaactccttggtctctgactgtagcaatatgtttaataactcaaggtacctgaaaataatgcaatatggcaccatgtcggcaatgtggctgagagagtggctcctgtacagattgcctgacttcacatccaggctccctcaggtgttacccatgcaagacttggcaagtaacacaactactctgtgttatttatcatcagttatacaattaggataattaaagtgtttgtcacagagggtagttatgaagacaacacatgtcaatgattgcagagttcttagcctggtgccaggtttatacaacacatctgatgatcactgactgctctgtctctgctgtctctatggttgttgtcatggacataaaagatgtccgtaaacctgctcatgatagtcatgacctcttcaggcttaaccgttagtacttctggttgtctcttcttgaatgagaaataaggagatcaataattaaacacctatgagattcttcaccgaagggagttcatgttgtcatcccagcactcatgctaggcttgtaggaatgtttctgttttgcagatttaagaaacctaaggctcagagaagtcttatcactttccttaaaccctaaactcctcatgtggccaaggctggattcatcccaacaccatttaccactaaaacctgtgtcttctagggaccttagtttgatgaccctggttaattcagtgcattgaaggtttagctctctcagaggttcaagtgagagacacattagatacctccctgcccaagacccagaatgtttccttttagaagcacccctaaccacacacctggaaatccaaggcttgtgcagtttatagacgctgcttttcgcccctgactgctgtatgtaccttgagcagcaagataattcactctaattactcagaatacatatttaaggacaagcacaaagaactcttagtgaggcttaaaaataagccattcagcaaaattgcacaaggtgcattccctcagaaggaagagtttattgcttctaaaagtgagtgtctaccctttgttggctgcaaatgtgaggcaaaggaccagctccacgtgaagcagcattttcctctttcagatttacctccagaaggagctccactgataggagattgctcctttctgctatgacatcttctgcgtcaaaggatctcattagtgtttgtttttatcaggtttttttttttcccgacttttatctcactcagagtgaattcagtgttcactgtcatttacaggataggaaatatatgtccgtttgcattgaaaatcctgcttattccatctagactgtcccagataccactgtattcatgtaggtttggtgttttgtctttcatctatttctgaaatcaaaattttgttaaaaatgtttcgggaaagctcaaaagaattggcccattggaatggagtgaatgcaggctttctccatgcaagcagccatgctttcctagtcattaaccacctgggccttgggcctgtcatgttttttgagtctctgtttcttcctctggcaaatgattttgatgggtgtcatgaggatgaagtgggatgatgtgaaggacttggggtgcttaagaaatctcccaggccattcacaagccacatgcctgcaaagaagtcttgggtgagcagatgccaagtttcccagcaaagagatttctaaggtgcagtgcttcagcttgacattagagagatggccttggccggcagctgaggttttccttctcttttgacctgagctgggaagaagtgtgggtactggcagctttcgtgggggtacctctaaaatagagcagcagttccctgttaggaatggcagatgagattgtgatgaatgcaacaagggctggagcacagaacattctgaacggactattactccctcaaccctatgggctacctgggccagagagatatacacagagaagactggtcaaaggggaaagaaaataattccttttaaatatctaggcaagcagccaacctcctctgatacagggacctgtgacaaagacagacttggagcatgtaacttgtgtttgaaagcatacgccagacccgtaacttcctcttgactttccaccccacctcttctggattacccgggtctgcaggtgaaattccagttgatttacccaaacgggtgcaagtgcagaggaaggagaacatggggaaagaggcaaaataaattttaaaaacagagagatagaaagaaagagaagacatgaagggcgaaggaaggggaaagagaaacagaaaaaggagatagaaatagagggatggggccgggtgcagtggctcacacctgtaatcccagcactttgggaggccaaggcgggtggatcacttgaagccaggagtttgagactagcctggccaacatggtgaaaccctgtctctactaaaaatgaaaaaaaaaaaaaaaaaaaaagccaggcatggtggcacgcacctgtaatcccagctactcgggtggctgaggcatgagaatcaattgaacctgggaggcaagactgtctgaggaaaaaaaaaatagaggaacagaggggagagagaaggagagggagaaagagggaaagggaaggatctagctaggcacacataattgttgtcttcctaaaaacaccaccaccaccccacacatacaaacaagaaaggcaagtgacattacaactataggtactgacatttgaggctgtgtggccctgtccaccgctctaggttgcatctcagtgaatgttccaggttctgaacaatcctataggtgggggaaagaggttaggtggaccaagcatggtactgtggcagcacctccttctcctactgtttctgcaccccgccatgcatttaaatcactcagggttggtgtttaacagacacaactcctgagctactgaatcaaagccttagggaatggccaatgggaatatggttttaacaagtattttaggcaagtcttacaaatctggcctgacacatgacttcacataaaggtttgagaactgagagtctcaccactcacatagaatgaagggtgtcagattctgggagatatttgagatctgatagaaattacaagacttttttacaggcctggtaatgatcatggagatgccagcagctatcactgccaaggactgggtgggttctaggcacctgtcccttgtaacacctgaattggaaaactcctggataaaggtgactttcccattttcagaggagacaatggaatctcagagaagttgaaatgtgtgtgtacccctgtggtgacacaactgattgaatccagtcttaggcatattaaaattgagaaccattgcttaaggatttcttaacagctgtattttattgagagtctgcaccatgctgggcagtatctgtgtgtgtgtgtgtgtgtgtgtgtgtgtgtgtgtgtgtgtgtgtgtgtgtgtttattttttatatatttatttttttcaaatggactctgttgtcaggctggagtgcagtggcacgatcttggctcactgcaacctctacctccttggttcaagtgattctcctgcctcactctcccgagtagctgggattataggcacgcaccaccacgcccagctaatttttgtatttttagtagagacagagtttcaccatgttggccaggatggtctcgatctcctaacttcatgacccacctgccttggtttcccaaagtgctgggattataggcgtaagccaccactcccagccatgtctgtgtattctaaggtgtttatttccatttgtcttcccaatgactttataaagtgagagagaatcctcattctatggagagggggaataagaccaggaaagcctgaattgaaaccaacgcttactcctaaagactgggctttgagttgctacattatatttcacacctctgtcctttggaggtgaaagttacttgatggtgatgtctttagggaaattatgacaaaggagaagtgaacgttggagtcaggtcattgtgtgtctgattacttactggctatgtcacctggtttataaaatgggcttgatttaatgtactgagtgaattagtgtccccccaaatttatgtccacttggaaccttaggaggagatctcatttgaaagtagagcctttgtagatataattaaattagatgaggttatactggattagggtgggccctgaattcaatgagtgttgtccttgtaagaaaaccatgtcaagacgcacaaaggtaagaagtccaaggggcatcaaagacagattggactaataccagggacaccaaggattgccaggagctaccaggatctaggaaagaagcaaggacggactctccttgagagccttcagatggagcatggtttaggcaacaccttgattttgaacttctggcctctggaactgtgagagattacctttcttttattttagtcacctagctggtcataatatgttatggcagtcctaggaaagtaatagcacatgagatattttttcttgtttgttgttgttgtttttgtttttgttttttcctttatagcacttattgtaactagtaattttctttgtttgcttaccaattctggacatactggaatgtcagcaccatactgcattttgttcatcatccccgtatctgtgatgcttcactccaatagcagctcagttacgatgtgtgaacggaatgtatgaatgaatgaatgagtgaacagagctgttgtgaggactaagccgagcagtacagtgaaattgcatcaaacagtgtctactaagagcaagcatgcagaataaaagctatcatgattatcattcgaggcaggaattatctttttttcctagggtccctctgccttgctgagcatcaaggtgaacttgagtagttactagttacgtggactgggagaacacggttaaagtaaaggttgtttttgtggagattgacaggcaagagcccctgcctttcctttcctgaaacagcagttttcctttgagacacgaagcccaccactgagagaggcagggtgcgggtcatgggggtggaggtggcggcattgtttgcaatcctcttggccccttgctcacagccaggcctctgcctttatattcttcggggggctttgatctcacctccctgtccaacagatgcacattagtcagtaattctaggagacatcaaaaccccagccctggcaccccccgaccttccctgcagccttcacaagccgctagctgtgttaataggcgccagacaggactgtgctatttcttagagcttaggtagaatgctactgcggctgttttactgaaccccagctcagtctccacttctttccacctctgacccagtacgtttagaattagagccaaatgctctgagtgaagagttgcccgacacggtgacttgatttacctaaggctgctatattctttccgaatgttctttccagacagaggtggagggcaaggaactgggtcccaggagctagaaaacgtggtcttgggtctcagctctgccattctgacactgaataaccatcatcaagtcacagacatcctcagagcctctgtctctgcatcgggggagcagaaccaggaatgctggtcctgcctacctgacagaactgttttgagagtcacgtgcaaaatcagatgtgagcatgccttagaaattggaaagtgtcgtaaaactagaagcacttattactattattctgtgactctgagcttataaaaaaaaaaaaaaaagaaaaagaaaatcaggccaggcacagtggctcatgtcagtaatcccagcactttgggggacagaggcaggtggatcacctgaggtcaggagttcgagaccagcctggccaacatggtgaaaccctgtctctactaaaaatataaaaatcagccaggcatggtggcacgggccagtaatcccaggtacttaggagcctgaggtgggagaatcgtttgaacccggagggtggaggttgcagtgagctgagatcacaccactgcactctagcctgggcaaaagggtaaaactccacctcaaaaaataaaataaaataaaataaaataaaataaaataaaataaaataaaataataaaataaaattggttacttaccttgtgtcagctgttgcagatcaagaaactaatacaacgcaatcccttatggtgtgcttaaacccatattcaatatagaaaatatagtatatccagataaataataataagcatagttatttcatcacctcgttgaccacctggttgtttatcttttgagaggctttgcaatgtttgacaaaaaattagaaaatagataaaaatgcaaagatgatacctgctatactgttttgtggatttctctttaacttaaaataccatacatacaattccgagtcattattcaatgactattcagattttaactttttgttttctctgatggcttctttgtgtctcattgcctgggatcatttggattggacatagtttatttagccaatcccttgtagttggacacttaaattttttcccatttttcactgtgacaaatatcaccttgatgaatttctttctgcaaatctctgcacactaccgtgattgtttctgtaggataaattcccacaagtagaacttctgggtcaaagagtaaaaatgcacattttttaaggcttttgatagtcagataaaactaaaacaaaatcaccctctagaaagatcataccaatttaaactcccaccaagactgcacggcagtgtcctgtctcctgcactcacaccagtatcaagcattatctcagagtgatttaaaatgcctgaagaaaggagtgataatggtttctaaacagcactggctaacgcacagccctgcatattggctttcagcttgataaatactttcttataaggccataaatattggtggtaccaaaggttaacgtagtgtgcaatgctgtaaaatccagcaggcaacctgctagctcataatgatgcattagcacctttcgatatgaagtgtgatgacttacaaagtctgtttgtaagtggccactaactcaacaagtgtataattgtgtcagttggcaccacagtttctgcaaacataatttattaagtgagcaccttgccttctgttatatgccaaaaatgagaagaaaagacaagagaaggggaaagaagaaaatgatcatctgactggggcatttagtcccttctgcaagctagggttacttaaaagaccaacatactttattgaagaaaaaacaaagcaaataatcctttccatattttaatagtcagttgaccacactgctggcagtgttagaatcaggattgaggcaggcatgacaaatagctgcaccattaaaaggcatgtgcatttgcaaattagacttttaaatattttattttcgtgtttttaagtttgcaactcaggcaccttgctcctaccattttatttttgcaggtggaaacagttgtatagttctttgctattgttctgggatgggctagcatgaaggtgaaacctgttttgtgattaatgaacatggaggttgtgtgtatttaacagcagaagagtaatctatcctgataggagacaaaacagaatggataccaccagccgtgttcccgtttggctttgctccttggtaatggaggaaatccaggtattaaggatagactttagtaggcccatctcagcatttgcccgtgtgtagtgcctgttttggattgctgtaaagaggacactctgtaaacagaaaataagctagacaggcacattttgagctacttattctgttcattttcagtgactgttcaccctgtgcaatattttgaaacaaaccgaggagttattcacgtcatattctttcttactcgtttttcatattttatttttacttttgagacagagagtcccatctgtcacccaggctggagtacagtggtgtgatcttggctcactgcaatctctgactcctgggttcacgtgcctcctgaatagctggaactacaggtgcctgccactatgtccggctaatttttgtagttttagtagagacagggtttcaccatattggctaggctggtcttgaactcccaacctcaggtgatccaccggctgcgccacccaaagtgctgggattacaggtatgagccactgcgcctggcctcgtattagttgttctttaaacatttacatttgacactgagcactgggaatacagaggtgaatggcacctactccatccctcaaggaactcatcctagtctagagctgtgaaccaatgcaaggggcaaatgcacacacatgcggttgcacggatgagcaggatgctctggggcaggagcgggggggcagtcaaacaagtccaaagcttctcgcctccagccagtttcggctgctgttcacccatatctcccatcgcctgggagcaaagacagctttgctcagagttttcttctccacttgaggccgccatgtttgcctctgtctggagttgtcagcctggctactgactggtagaaatcagagaggaaattccaggcatgatggcatgttcctgcctattagttagggacccacttcattatgaatgacatagtcactatgaagacctgacctctctggcttctggaagaatgttgaacatgcagaccaaggaaaagccaccatcccagagctcacattccagggatccgaagaaacacatcagagtaatggctagcccagatggtgataggagagaaacagagaagagggtggacaggaaggactttctgaagaggcgacatttaagccgatgactaagtatgaggaggatccagtctggtaaacagtggaaggcagaggttccagagagaagagctggcatatgccaaggccttgaggtgggaaacaccctcgaaatatttacagagtggaagtagctcccaatgcctatgacttcactagcccccaatttggaacaaccattatggctgctgaatgctgtaggactgtgaataagcaaagaagtgtttgaaatgaggttataaaggtaggtagggccatgcaaaccaggtgaggagtttaggtgtaattctaggtgcaagaggaagccactagaaagttttgaagcatgaagagtacctgtattacggttctctaaagggacagaactaataggatagatgtatatataagggggagtttataaaggagaattgactcacgtgattacaataggtcgtctgcaagctgaagagcaaggaagccagtccgagtcctagagcctcaaaagtagggaagctgacagtgaaaccttcagtctgtggttgaaggtccaagagtccaaaagctgaagaacctggagtctgttgttcaagggcaggaagcatgcagcatgggagaaagatgtaagccggaagactgggccagtttagtctttccaccttcttctgcctgcctttattctggccacgctgaccactgattagatttgtgtccactcagattgtacgtgggtctgcctttcccagtccactgactcaatgataatcttcttcggaaacaccctcacggacacacgcaggagcagtactttgcctccttcagtccaatcacgttgacaatattaaccatcatcatatccttctctttttctttttcttttatttttttagagacagggttttactctgtcacttaggcaggagtgcagtggtgtgatcatagctcactgcagccttgtcctcctgggctcaagcgattgtcccacctcagcctccctagtagctgggaacacaggcacacaacaccatgcctggctaattttttaattttttatagagatggaggtctttctatgttgcccaggctggtctcaaacttctggcctcaggcaattctccctcctcggcctcccgaagcactggaatgccactatgcccagcctacccttctcctgagtgagttcctccagagtcttttttttttttggctgggctgggaaatacccttgagttccggagaagggaagtggtttctggaatcctctgcccgtgaaggttaatttggcaatatgcatatctgctctggggctatagaggcagctgtgacgatgcccagagggggacctttatgatctgagagcccgtggaatgtttgtagcagcagagccgtgttgtcccattgaatgtctcttccatttttaatgaggagcctgggggcactgtatcaataaaacgaccaaattattaaattatcactctacagggcatcttatattagtcctaattaaatgatgcttttcatattaacaaacagtgctcaaaaaggattctcatttttaattcggacctcattgaaataggaagccttagaaatttctagaataggtactatgcctctggacgaatatgcaccatgtctctggactcactggagggcacctacagtgagttttcagacactgccctgaattttaaaaatcctcagtatccacaatgactacctgtcttcacccagactcagaaatgctaatgggggtcaggtgcagtgactcactcccataatccgaacgctttgagaggccgaggcaggcggatcacttgaggtcaggagtttcagaccagcctggccaacatggtgaaaccccagttctactaaaaatacaaaaattagccgggcatggtggcgggtacctgtaatcccagctactcaggaggctgaggcgggaaaatcacttgaacccaggaggcggaggttgcagtgagctgagattgtgccatcacactccagcctgggcaacaagagcgagactcaaaaaaaaaaaaaaaaagaaaaaaaaagaatatttacaggacttctgctttcgccacgatagagtaacagggactggtgtgcaccgctgccttaaagaacttttaaaaaggtcagtctcagaaattgccactaaagaattttttccatgcaaccaaccaccacttgtcccccagaaacaactaaagtttagaaaaaagtcaccatacaagcaacagtgatttcagacgttagacagcatgaggcatccacagaggggaagcagatgagatgtaccctccaggggccccagctcactgccttgagagggtctctaagccataggacaaggggtgggggcccaaataaggaatatttggggcgcacttgctgggtgaaagccatgagacactggagagacagtagtgatccagtcagccaatagctctgtgctactgagctgacattgttttgagggaaatggtcaataagtgagcaaataaatgggggtggtttcagaatgtgagaaatgttacaaagaactaaaaagggtaatgcagtggaatactgtgacctggaggagcaggtaggagttactctagctggttcagtggcatgcaggaagctgctggaataggctgccaagggccaattatgagcattactagccaaatctgtgttccatgagatcccactggtagcttgaaataggccatgatgtcaatatttacaccacagacattggcggtgtttttcttttttctttttccaacatactacggatggtatggccaagataggtttcataaagaagtgcacatttctgtatgacattaggataaagaacagcccatcatttatgtgacaaaccctaggaggaatattccagcagaagaaatagcatgtgcaaaggccgtgtgtccacatcctccatttcttcattctctatgatgttcagggcaggtatttttacccctccccacaattgtataaggagattttcattgtcacgtgtgtcagtcattttatctcattctctccaccacccgtttttaattcccatgttggtacagtagagaatatctttatccagttatccttccttcatccttagattttgtttcctgatttctctttccttgtacttcttttttcatagaattttacaacttgttttcaggtatgcttctttatttccatgtctatgagagctttgatcagcagctatagtttcttatgtaatccatagactccatcaatttcttttatagtgagaggcgacaggatactcattttacatctagaggcaaagtacttcagcactggaaggtgaaaagacttcagaagaccttttctggaagccttttctttagcagcagggtgtcttcagagaagttgcagagttgagtctaatggaacggcctgaatgaccactgggtcaatgttaattgataatgatgctttctaaggcgagatctgaactgaacctcaactcaattcttaatatgtgcggcagaagcaaaaacaagaaatccatagttcatgaccctataagatttatgtctaaagcatttccgacacccattctttgttgtgaacgactaatttgccactcttgtttttctttctttttttgcaatggagtgttactctgttgctcaggccgaagtgcaatggcgtgatctcagctcactgcaacctctgcctcccaggctcaagagattctcctgcctcagactctcgagtagctgggattacagtttcctgccacaacccccggctaatttttgtgtttttagtagagatggggtttcaccatattggccaggctggtctcaaactgccgacctcaggtgatctgcccgcctcggactcccaaagcactgggattacaggtgtgagccactgagaccggcctaatttgacactcttaagcataccttctctttcctctcagtaagcaagtcagatatttcaggagaaacaaggtatgtgctccttccttctttcattccttccctccttccttttttccccttcctttttaaaaaattttccagtttccacattttaaaattttatttctttctctttttagagacagggtctttctctgtctcccagactggagtgcagtggtgcaatcatagctcacttcagcctcaacctcctgggctcaaattatcttcccaggtcagcctctagagtagctggggctacaggtgcccaccaccacaccccctaatttttaaaattttctgtagagatgggatctcccagtgttgctcaggctggtctcaaactcctggccccaagtgatcctctagcattggtcttccaaagcactgggattacaggcatgaggtgccacacccagcccagtatctacaattttaaaagtggtatacatagcctaagatcttccataacaattaaaaatgagtgtcagacatgcaggactatcaggcactactgaacattgctgaatactcacaagagaagggggatacatatggcaaaatttcaaactcaaatgaagatctgcaagtggccagtgcacttgaaaggtgcacaactcatttcagaaggcactgctcagcattaccaagatgcagctgtgtcctaacccccagctacaagggagtgtttactgtaggttagagttagctgactcagtccatatgttagggtaatcacaacccaattttgatgaactcataaaccaaggaggctgttgctggagctaagaagagacaagatttttagtagatagtgacatttaacctcagctaagtctaggctgtcagcctggcaggtctttttgaagagctaagttctgcttaaaagccattagtgtatgtcaggctctatacattaggattaaagaatgtaagaaggccaggcccagtggctcacacttgtaacccaagcactttgggaggctgcagtgaggggatcgcttgagcccaggaggtcgaggctgcagcgaactatgatcggaacactgcactccagcctgggtgaaagagcaagatcctgtctcaaaaaagaagacaatgacccagatcctattctctcagagcccaaagcttagttgggctgatgggaaaactaacagtttcaatttaatgtgtgtattctaggatcgagctaggggaacaaagagtagcaggcaaaggaatgcacagaaatatttagtcatagcaggaaccgttcttcaactatcttccaaggactgtgctaaatactttccatgcattattttatccttacagcaatcctgtgttttatatacttttaggtaaaagtccattttagtcattagcaacctgagcacagagaggtcagttaacatactcaaggttgcactgcatgtggtaaagagctgaacagagaaaaccaaattcccaagttcagcctgagtcgtgtagactaagtgttagttggagtaaacagacttagcttctctagatctgcttcctatcagaaatgtggagatgttcaaagtcagctgcttacctttagaattgccatgaagtgaacaccagtgaattcagattagttgagcactttgagcctctaacctttttttttttaatttttttatttttaagcaccctacacctataacttaactattcccaatttggaaaaaaattttatgagtgctgtgcactctttttttcttcttcttctacaaagccaagtgcacgacatcaaacctgtaatcttggccacattatcaccatgttctaaccaagcaagcttattagttcagacaattaagaaaatagaagttgaaaatacttagctattagggagaacggagtaacataaatccaaggtgttgggacaattagcattcgtagtaataaaagccaagtagaacactaaggaaatgaatattatgtttattatttagcatttaggtagtattgcatatttataaaatacctggtaattgtttttggtcatttctttcagaataaatcggataaagggtatttgctattgttgtgagtagggtaagggggggtttttagtagaagcccattaaattacaatgcatctccccaccctcttaccctcaactcagatttaagtacagaaagaaaacattcagaaatcttgctgaaacagaaatcatttcacttttctcctttgttaaaagccttctgatgactcccccatttctgttgcagcaaaaggcaaaatcctgtaaatgcaacttgatgtcctagaatggattctggaacagaaaaaggacataagtagaaaggctgtggaaatttcagtaaaatccatggtttagttaatagacaccagtgttaccttcctcgttctgataaatgcacgtagttgggtaagatgttagtgttagaggaagcggggaaaaggatataagaggaccctgtgtactatctttgcaacttttttgtaaatctaaagttattcaaaaagttaaaaaagattttttgtttaaagctaaagttcttagagcagactacaaagacctgcgtgacctgtttctgtgccctcgtcaggtctctgacgtcatctccttttctcttccccttgaacgttctgtaccagcctcacgcttcatcactttctcaccgcaggacctttgcactggctgtgtctgggactgggctattattgcctgagctctccctgtggcccactcttctttgtcaaattgtgattcaaatgtcaccttcataaaagccatccattgaaaatgtcaagcctacctccacggtcccttcctcctgctcagtatttatctcatggtgcctatgcttccaacatgctctgcaatgctctgattgattaggttatgcttcatcttcctcctgctctcctaaaacttacgttccttgagaggagggattttttcctgttttctccacgatgcatttccaacacctggaattgcatacttagtgcttaatggatattagttgaacctaaatattaaattttatactacaagaaagtaaccctaactctgaatgctttgataaccaaggcattgtggtaaacactctaaattttctagatcttgtggcatcttcatgatagcttaaaatttgagtatcatgaccaccatttataaggccctgagaagtcttaagttttgcacaacatgacgcagctcttcggtcaaatctgagagcccagattcgaacttgcatctcccaacactacagctagttctgtttcttgtacaccagattgtctgctagatttgcatgcttcccctccatttcattaaaccacggcacatgaagaaatagcattactcatcaagtcagtagttgtttgagtaactcagatccctttcttagatgatggtacccaagataaatgtatggaacatattatttcccatgatggccacaggtaactctggaatattataaggtttatttgtataagcaactcagtatgaaacttttaccttgaatttccccttcatgggcctatctttgttttcattttcaacattctcttttggatacagagtttcattcacctaagaaagcttcatgacattagtggaaaggcactggttcagttctaagaccttagttctaggacccactctcctatctgctagctatatggaccccttcttaggctttaatttcctcatctataaaatgggcataattttaccaccaacttcatagaggtatcatggggataaatggtataacccatgtgcaatggtatgcactgctgttattgtttgaaaataattctttgttgaatcagatataaaggttgttattgttgttttctgaaaccgacttagtttaaaattactaagtcattttaatatctatcaaccatttccatagtttctaaggatttctcccaaatgcctctgttaacaacaacgacatcctcctcctcatcatatggatatcatgaaacaccaattatatcaattattgaacagttatttggagtcaggcttgatacagtctttgtaatgttgttttattttttgctgtgagtccacagagcgagtattataaacccattttacagatgagggaactgaggtaccatggaggtgaagtaatttgcctactgtcacgtgctactcatggggccgggtctcgaacccaggtgtttcttcctatagctgagggcttcatcagtacttagcacagctttattgccaaagagaattgtaaagcaactggaaaaatgaccaaaatacaatacctccaatgactatttttaaaaaaacaaaaaacagccgggtgtggtggctttcacctgtaatcccagcactttgggaggccaacgtgggcggatcacttgagatcaagaattccagaccagcctgaccaacatgttgaaaccccgactttactaaaaatataaaaattagccaggcatggtggtgggtgcctgtaatcccacctactcgagaggctgaggcaggagagtcacttgaacctgggaggcagaggtttcagtgagccaagactgtaccactgcactccagcctgggagacaaagttagactctgtctcaaaaaaaaaaaaaaaaaaaaaaagaaaaagaaaaaaaaaaagcattttcttaaactgtggcccagaaagcacttttatattagaattacctgatgcgcttgttacaaacacatattgctggctgtaatcagtgaagtgctagtaaatgcttaacaactagcttggtgggggaaggagcgggagagggctccagagactgatctgaagcatttgccaatttccatggtgcaaatactcccatcatggccattgcaagataccaatgcctcgtcactgaacacagagttaggaaaaaatatgcagaagtggaccatcacgcagtatttccaccatccagatactctaaacaaacaaacaaaaaacctcaagagcacagataatattcaagtatggtaaaataatttaatattcaaaactcattatttcttattaatttttaatatactttattgaggccaggcatggtagctcacgcctgtaattccagcactttggggggccgaggtggtagatcactggaacccaggagttcaagatcaccctgggaaacatggcaaaactccatatccactaaaaatacaaaaattagctgggtatgttggtgcacacctgtagtcctaggtactcgagaggctgaggtgggaggatcacttgagcctgggaggtcgcggctgcagtgagccatgattgtgccattgcactctagcctttgtgacaaagtgaggctctgtctcaaaataagacatacatatatatatacacgcgcacacactcacacacatatatatttatgctatatatgtataattatactgtatgtatatatcaatatgaatatatacatgtatagtacataaatacatgtgtacacatattttcgtatatgtatatacatatacaacatatattaatatgtatatacatatactttcttactatatatgctttaattatgggcttatgtcatttcattttttattaaaggttgtgtttaacaacagagtcacagaattcctgacaagttagcaactggctttcagaaatcagtatcaacaaacttcaacagtccaccagctaccccaggctgacaaaatcagcaccgaaaaggctggagccctggaatgtgcatttctaaagagcatccaactgcttctggtgcacactcaaagtattgagccaatgccataagcctttctgagagcacttgtgaaataagtatatgaaaatactatataatgtggtaagcatctgaaaaatgtagatgggattcatattcctagcaaatgctagtgggcatttatgctaaatgaaccccactgttactcttttgaagatttttttccctacttttaaaatggcataaaattattttatagttttattttattttacccatcaatgaagagtgcctggtctctgttaaaggagaaggtagtaatcctatttcccttgcagccagcataggagaaaggttcagaggcctttcctgaaaggtttaggcaaagataacaaaatgtcagagaaagctgcagggcagggctgaatggaaaagtaggtttgtaatctcaaattcaatataaaagatcgaaagtatcaaatagtcagtggtgagcctctccatcagaatgttatatctgccatgaaattctgctttatgattgtattacgttatatacattatacatctctttctctcagtctctctctttctcacctagtctctctttctccctctcttcctttatatattctcatagaaactagggcacatctgagatccataaggaagtcttgcttgactccagtcagagaaaccattggaaacatcacctgcctccaaccccaaccccatctgccttaaaaatataaaagtctttctttttaggtggaggttttgattcagggaaaacacaggccttgcaaattaagagcagcccaagaattgtgtgcaaaccctgatacacgagacacccaatccaaggcttgcactctgtcctctaaacagtgattgtgctttccaaggtggatatggagggtaattaagaatgaattttcatgacttgtgtctactgtgtgcccacacagtgccagaagccagagtaagaactttgcgggcctttcgcttttcatctaccctccttagtctttggttcttatccaggcacttaggagtttctcaatcagtattctttgaatgaatgaattcacaaatccccattttaaggctgtgggaagaaaggcctttagggatgaagtaacatgtccaaggtcaaatagttgtctttggtcaactgttggtcaaatgctacacaattacaggattgcctccctaaggtatagacagtggctgttaaaagaatggatcctatttgtcacctgtgaaggttattttaaaagatttatcttgagtgcataggagtatgaatgggtcactctgggatggggcccagaaatctgggtgttccacacccttacccaggtgacttagagacattcagcaggctgtacctggagaaagaccagtgcgattcatgtaaatctctctacatctccaaccagaggcaaacctgtcaacttttctggctgcaaaatctgcaccttgctaaaggctgtcaagaaccccctatggggggtggacttcttggcttacccaccctccctacatctctgatccttgcatttttagacgtgacaggtgcctgcaaggccaccaaatttcatgtcttcagtttattcagctgcaaaaaatttcatttcagaaacatgacacaatgagaaactgacaaaaggtgggcttgaattcaagtctcctaaatgaaagtacccccagtgactaaaagtcttgttgctgctccggatttcacattgtcatcctgcggtgggaacatatcttgcatttttatgtagagtatcaaaaaaaaaaaaaagcaaaaattgttttttggaacagccaaagcgtgtcctggagcataatctaatttgtttctctatggcccaagaaaagagggggcgagtgtcatccttcctttttcataaattgagattcagaaagggcgagtgactttctcagtcacacagcatcatgtctaccacccaagtctcacccgcttctcattggagccacaaatgacataattagatgagagatgatcccaagactagcggatgtttccctttcttcattttaagagtttggacttttttaggggacctaaacatttgctcctgagctctgctaatgtgtgactgctgagtttttctggatgaataagacttttttcaagaaatttcacatattcccgtctggccgaattatgtatccaaatgtttttccatcagagaactcatccgttgtcctgtgactgtgtggtttattcatttctcctccacaaagctaggagctccctactggttcaggttatgtcttcttcatccttcagtccccatatgtagcaaatgttctttatacaagcagatcttaaaatggtagctgagttgaacagtgtagacacagagtatttgtccctctaagaaccaacatgggaatccatggagctcagaccaaatccagcccactgtctctgcttttacaaataaagttttatcaaaacacagccacattcatggttcatttgtttacatattaccccatggatgcttttatgtacagcatggcttatgatgcccaactattcactctatggccctttaaagaaaaagcatgctatccccatctagatgaagagacaagtagaaaggagatgcaggcatttctattttcagagtatatttcttagcatttccatttccgaacatatatttactctccttcccacctgccaatgcaggagaaattagcctactgagaaactccgaaatatcctgactagtgtcaatttgcagaaattgtgcagtttatgtgacaggattctttcactgtcaaatttttgttcagagacatatcggtgttcacaaagaatgatatctccatgtctcagcatatcctggaaaaaccccagtagtcctagaacaaaactcttggagtgcttgtctctttgtttgaagcatttatattaatacaaagaaagaagtaattagccaggaaaacccagggatgttcagggagatcagtgccatcttaaattcatcacccattttctgcaactgaattgtgctttcagcagttttcttaggtctgggaaattagcataacgtatagaattgccatttggttcatttaaatcttgcataatatattaggggggaaatctttgagctaagtggaatttaggatttagtaccaaatacgaacttttgtgttaaattgatgtataggttggccttgatttctgagtgggacaggtaattaaagaaaaccaggaggttaagaggagatgaggaaaaaaaaaatactgcaggaggaaaaggttggaggcgtcagccagaaagggaggctgctggaagattgctaagctagagaacaatgcagctcatttttatgagaccattaacacagaagacagtggcaacaatcttgggagtatttgacatgttcccaaaattagttgggtgcgggatgtcatggcacagagctgtgtacctgctttttatctggggatttataaaagtggagccttgctggtgtcgtccaaaacagcaggatgggaaagagctgttggtgagaatgcattagggtacctgccgcctgttccctgtagttcctctggctcttgaaagagcctgaagttacagaagagggcaggagttctaagggtgtccaggaggccaaatgctgaaggagaggaccctcatctgaaaggagagttggaagcaatgaccattggcaacagccttgaagacacgagaccctgggcaactatggagaatgacagaggatggctgatcagtgccccaagtaacctaggaatgtggactccacagccccaccacatccatggaagccaccagtggcacctgagccccagcagaatgagatgggaggcaaaaagaggcacttctcatcaccaggatgcatttgatttcattagctgccttctgcctcctaggttccttctcttcagcccccagtcttgaaagaagcttcttccccagtgggggaaggaggaggaaggtcccagaggttgcacctcatcccactgatcctacaaactgctggagagtttggagccaacaggcaagaaacactctatgcccactgtaggtatactggaccacagatgtgtagcaagaggaagagagttttaatctcattgattttggaagctttaaagtggactggcctgagttttaacaaccaagtgccccgagagctgttgcatcttctttagatgccattaagggacttgacccaggggattgcaatgccagggctctaagccactgtgccacactgcctcccatgtagggactaaacatcccaaagaagctctgaggccctctgaacctcaatttctttgccgtaagatgggcacaatattagaatcctcttgtctgagtcatcagacaatgtgaagagattaatagaatgctaatcactcaaccaggatttattaaatggcaatgaagtattaatcagccactcttctcgatgctggttattataataatcatggtccatcctaagcacttacaggtgttgactcatttggggtagatgccaatagtattcctattttctagataaaggtaatgagacagagaggttaagtaacctgctgcagttcacacagataggaagcagtgaagctggaattcaaatctagataattgtgtttcgaagtctataaatgtgtcttgttgttattgctattgttatatatatacatgtttttttcttttcttgcttcaaacaaagtcttacactgttgcccaggctggagtgcaatggcacgatctctgctcactgcaacctctgcctcccgggttcaggcaattctcctgcctcagcctccatagcagctgggactacaggcacacaccaccacacttggctaattttttgtacttttagtagagacgggggtttcactatgttggccagactggtctccaactcctgacctcgtgatccacccacctcggcctcccaaagtgctgggattacagggctgagccaccgcacccactctattatatattttaactacctatcctggaaccaaaagccaaatctttgcaacaagaagaggagaagaaagagtgctttttgtagtcttgtcattccactttctgataagcagacaccaacctccaaccctgcccactgtaccaccggggcctgatgtatagtaggtgctcagtaaatatattttgaatgattggataactgagcacctgatttcaagcccccaggacaaacaatgcttctttaagtgcaggtgtttgtaggcgctgcctcagtaacacagctgtggactgaattgtgtcccctactccaggtcatatgttgaagctgtaaccaccaaagggatggtgtttggaaatggggactttggaaggtaattaggttaatttaaggccacgagagtagagcccgatgagacagtatccatacaggaggcagagatatcagagcttccctccctcttccatctgagaacacagaaaaaaggcactcaagccgggcgtggtggctcacccctgtaatcccagcactttgggacgcagaggtgggtagatcgcgaggtcaggagttcaagaccagagtggccaacatgttgaaacctcctctctactaaaaatacaaaaattagctgggcgtggtggcaccagacacctgtaatctcaagtactcaggaggctgaggcaggggaattgcttgatcctgggaggcggagcttgcactcagccgagattgcacctctgcactccagcctggctgacagagcaagactccatctcaaaaaaaaaaaaaaaaaaaaaaaaaaaaggcactcatctgcaagccaggaagagggcccttcccaggagctgagttggctggcactttgatcctgcactaccagcctccagaactgtaagaaataaatgtctgttgtttaaaccacccagcctgtggtattttgttataacagcctgagaagactaatacagacacctagacaaggctgtctcctttactgatgtgttaaacacctggccccttgtacattcatcctatttttttcccaaggaataaaaatagcaaaggaattcggagtcagcccttctctgtcctccagcccttctcctttcagaggaatttcatcactggagcagagcattgaattcattcgagttgcagggaaatgtgatgtatttcttaaatctgtgtcacctggccgtggaatcagcccagccaggctcgaaatgaggcattaactacatccaaagctgtgtgattaacttatttgtttgccgacggagctcaaatgaaaaagcaggaagctgggaggatctgcacgagccccgttttgaagtaggattgtgagaagacccgaagtgtgggttttagttcacattccctgggcttaccattattattacttttaatggaaaataacttttcacaatcttgcttcgttttaaatggagaatgtgcaatattgtctaatttagggtgtggagttgatctggtatgcatgatttttcttcccccgcccgccaccatccttggattctttgtacacattcaatatagttacatttttgcttagaacatatatattttcccccgaacttttctcgattgcttttttatcaggtttacaaatcaaatcaaataggtatattgcagagctctgcgatattattttctgagcttacagtacaatgtattgaattatgccagcccatgctctgccctgctattctctgcagactgagagagggggaccgtggaccctgtaaattcactcggcgcccagcattactggctaaatcaagaccgctcttcagtctgcaagaagagacagagcaagtgttcgttacacaaatcaatttggtccaaagtacttcgcagtgggtactcaaccatcgctcacataatattgtcaacttaatcaaataatgcctcgaagacactcagaagcttttctctctgagaaataacttgattggtggaggatggagcagcagctggctcttcaaagtacactttttatttatcactgtgaagagttttgtgcatggaggggaggaagcctgtaggaaaggaaagaggctgaatagtcagtaggctgactgtggggagaatcatgcagcattcatgtcgtgtcttgggtgctgggtttctacaccgtgatggtgaatttggggatgctcgtggatgaagcagcagctgggcccaaatcattagtttcctggaatgattcaggaaagacttgccgagcgcctactatgtgtcatggtaaggggcttttgatatagtgcatctgatacagtgtttatccacgggacgctcatattctaggaagcatttgatatggtgtttagtcatggggtgctcatattctcgtaagcatttgatagagtgtttatccataggatgcttattctaataagaaaacctgtcagtgagggcttaacagaggtcaacccaggactctagtagttcaaaccacacagctgaagcagcctgcttttgattgctttttaattggttggatgagctagggcctcattcacccacctcactgctctgtttccagcccagacctagaacataggcagttagggtttctgtgaatctttactcctgtctatatgtactttgcagctgctctacgtgcctgctcttagactttccagagcattttcaccttgaccttgaaaggccattcaggagcgaaaagagtttaggatacggaattagatatcctaagttcaaaccttccatctcctggctgtgtgacttcggacagatcgcctaacctctctgagcctcagttttcctagttgttatggcgactcggtaaaataaggcatggaaaacaccagtgagatgcttagctcatggtgggacctcagcacagttttcttttccatcctgtatcccagaccatttagccagtttcacattttgcttataaactacgagtggcattcagcatcagtgatagccggaatcctttgtcttaactcaggataggggagaagcaaaagccttcctcagtgatccttttccacatccaagggtgtctatgtatcctccagggagcttgtgaactttctgaaatcgtatgcaaaatttaggtgtatgtgtattttccccccaaaaggtggtccacagttttcataaaaccttcagtgtatccatgaacaaagaaatcgattaagaaacatgtatttacagagtaaagggaaataccacccaaaaataatggtatcaacaaaagtcacagctgacagctactgctaatggaactgactgcctgagcgacccactctataattaaagctggatatatatatatctccctatatatgtatatccatatatatctccctatatatgtatatccatatatatccctatatatatatccatatatatatccctatataaatatccatatatatatccctatataaatatccatatatatatccctatatatatatccatatatccctatatatatatatccctatatatatatccctatatatccttatatatggccctatatatatatatatatatctccctatatatggccctatatatatatccctatatatggccctatatatatatccctatgtatggccctatatatatatatccctatatatatatccctatgtatggccctatatatatatatccctatgtatggccctatatatatatccctatgtatggccctatatgtatatccctatgtatggccctatatatatatccctatgtatggccctatatgtatatccctatatatggccctatatatatatatccctatatatggccctatatatatatccctttatatggccctatatatatatatatatccctatatatggccctatatatatatatccctatatatggccctatatagatatatatccctatatataatccctatatatatatatccctatatataatccctatatatatccatataaccctatatatatccctctctatatatatccatatgtatacctatatatatccccatatatatacctatatatatccccatatatatacctatatatatccatatatatacctctctatatatgcatatgtatacctatgtatatatatatatccatatatatgtatggatacctaaaattaaagctggatattttttacagtattgcccaagaaaaaacattaaaatgccaaatttatttcatttaaaaatagatgtatttgaaacttagttgactcaataatattcctcatttcaaaggattctattgctactggaaaggggtcctgatccagacaccaagaaagggttctaggatctcacacaaaaagaattcgaggtgaatccatcaagtgaagtaaaaataagtttattagagaagtaaagaaacaaaagaatggctactccataggtagagcagccctgagggctgctggttgcctgtttttatgattatttcttgattatgtattaaacaaggggtggattattcatgagttttctgggaaagggttgggcaattcccagaacttagggttcctccctcttttagaccacatagggtaacctcctgacattgccatggcatttggaaactgttgtggtactggtgggagtgtctcttagcaggctaatgcattgtgattagtgtataatgaacagtgaggatgaccagaggtcactttcgttgccatcttggtttcggtgggatttggctggcttctttacctgttttatcagcaatgtgtttattacctgtatcttgtgctgacctcttatctcatcctgtgacttagattgccttaactggctgggcgcggtggctcatgcctgtaatcccagcactgtgggaggccgaggcaggtggatcatgaggtcaggagatcgagaccatcctggctaacatggtgaaaccccgactctactaaaaatacaaaaaaaattagccgggcatggtggcgggcacttgtagtgccagctacttgggaggctgaggcaggagaatggcgtgaacccgggaggcggagcttacagtgagctgagatcacgccactgcactccagcctgggtgatagagactctgtctcaaaaaaaaaaaaaaaaaaaaaaaagaatcacttaaaactgtctgggaatgcagcccagtaggtctcagcctcattttatccagcccctattcaagatggagttgctttcattctcctgcctctgacaattacggtcattgtcctagggaagactttctttctctactttcctcccttttaaacccattatccgttatcgctttttcttcccccagcacaccatggctctaaaacaggaccgtcccattgacagtgatgaaaatgttctatacctgtgctttctgatgagcgtgcaatagttttcttttgctgtcagatgaccatacacctagtaacttccacaacacaagtatattaggttacagttctggagatcagaagtgtagcatgggaatcaccaggtttacaaggattgtagctggcaggatgatatttctataggctcataatttgatctttccccatgcctttcctggcccctgaaggccactgtcattcttgggctcatggcccctttccccatcttcaaaatcagtaatggtgggttgagtttttctcacggggtgttcactctgacattgggggttctcttccatgccactggcctctgtttcacttctcaggaccctggtgattatacagggcccacacaggtaatccaggataatctattttatggtcatgtgattagcaaccttaattctccattgccatgtaaagtatcctattcaagattccaggtattagaaccttaacatctttaaggggtcattatgttgttttccacagaaagccaccaaccacaggtgtctgttgagcacctgaaatacagctagtgaggccaggtgtggtggctcatgcctgtaatcccaacattttggagaccaaggcagaaggatatcttgagcctaggaagttgggattgcagtgagccttgatcattccagtcttgggaatgggagtgagcgcctctgtctccaaaaaaaacaaaacaaaacaatacagctagtgaacttgatttaacttcaatttgaatgtaagtactgatacttgattgttattagtttgtttgggggatccttcacatgtcattttttcaaaggctaaatataaatcaagtatttccaatgacaattcagtttccatatggagatgtgtaaaatacaagatttcaaagacatcctccaaaaagaaaagaatataaaatatcttttacatgatagcatgttgaaataatatccttaataaattgggttaaaatgaacgttcttaaaattttactttttttttttttttaaaaagtgacttctaagaattctaaaatgacgtatatcacttacattttattttacaagacaggcttctctaaagtccttcaccagcatccttgagctatatctaatgctgtgtgatgagtgcatgtatttttcatttccatcaaatagaatttgctacagttcttattttatttctaattatcccctctcccctactgagcacagaacttcaacatctctaatttctgtctgtattctgatttctactgacaacttcatggtggtatcatctaccacattttactcaaccgaaactggatgagtaaggactgccaccagtaccctggacccacagacaaccctgagatagaagtcatttatctacgcttgcagctaggctcagaaggatgtacatagctggactagtgatgaaactagagttttattgcagagctacctagccataaatattccttccctgaatgtacattagctcaaccattgtggaaaacagtgtggtgattcctcaaatacctggaaccagaaataccattttacctggcaatccaatttctgggtatataccaaaggaatataaatcattctgttacagacacacatacacatgtatgttcactgcagcactattcacaatagcaaagacatggaatcaactcaaatgcccatcaatgatagattaaagaaaatgtggtacatatacaccgtgaaatactatgtagccatgaaagggaagaagattatgttctttgcaaggacagtggatggagctggaagctttatactcagcaaactgatgcaggaacagaaaaccgaacactgcatgttctcactcataagtgggagcaggacagtgagaacacatggacacagggaggggaacaacacacactgggggaaggggcgaagggagagcatcaggataaatagctaatgcatgcggggcttattacttaggtgatgggtgcagcaaatcaccatggcacacgtttacttatgtaacaaacctgcacatgtactccagaacttaaggaagaaaaaaaaatccttccctgtgcttctgtacccacttacctggtcatcactagaagatgccacgcaggtggcctcagtcttgtctccctagggtcagacagaggaaaccccaggagggggacagaatccaaaaggcatgtatctctacacgactatgcattttctctccaacagtcatccctggattggtcgatatcaaaatccaatttcaccaggattagtctcgggttgctcagagctattcattgaattaggaacgattatagcagagggagccccgtggttctttattaaggtctttgtggaagcactaagtgatcttcaggagattaaagtgccagtggtgttttcttaacatttataacctgcgccgatacctggggagtttgtgtattaagaaaaattctgccgcacagatcccgcctcctaataaggccttcacactgggcccgggtagaagctggcattgtggtcctaatgagcttatcagggaagctctgccaagtgccgcctggaaacccacctcttggggttaatggacttcccatctgtgtagggtcctgcagcctttcctgtttgatggggaggctgcgtctcagagttgtgcatggcctgagaaataaaacaaaagctaggcccggcgccgtggctcaggcctgtaatcccagcactttgggaggccaaggcaggtggatcacctgaggtcaggagtttgagaccagcctggccaacatgatgaaaccctgtctctattcaatctaaaaattagctgggcttggtggcacatgcctgtagtcccagctactggggaggctgaggcaggaga[145 bp omitted]tctttatacaagggacttaaccattcacaaagacttggatgtaatttcactctaaagcatccaggacaagtatacatttatcattttatgtatatgcaaatggagatccagagacatgaagtgagcagacttgcaggtcgctcatggtaaggcttagtcatttacgctgcagatatttactgagaacttaccacggactccaggtcagcagtttcaagtggtacagttttgcctcccaggagacatttgaatcccaggagatattttttgttccaactcacgggtaggcgactggcatgtggtgggtggaggccagtgatgctgttgaacattctgcagtgcacaggatgatccacccatcaaaaataataataggctgggcgcggtggctcacgcctgtaatcccagcactttgggaggctgaggcgggcggatcacgaggtcaggagatcgagaccatcctggctaacgcggtgaaaccctgtctctactaaaaatacaaaaaattagctgggcgtagtggctggcgcctgtagtcacagctactcgggaggctgaggcaggagaatggcgtgaacccaggaggcagagcttgcagtgagccaagatggagccactgcactccagcctgggcaacagagtgagagtctctctcaaatgaataaataaataaataaataaaatgaaccagccccaaatgtcaatggtactgacattgaggaaccgtactatagtggtagagggtttcagtgaacagaaaagccacagtctctgctctcctcgagttacatcctggtagaaaagataggcaatatacaaaatcacagaataaaataataaaaaggcaagaagagatgtatgctgtgaagaaatcagtggtcaaggggagagagagtgctggtgcagagttgctgtagatcatagggccagtgaaggtttctccaatgggtgacacctgggcagagattgtatcggcaagagggcaagctacaggtggtgtcccagggaaagagtcttccaggcaaagggcagaatgaatgcaaagaccaaagatggggtcaggaaaagcaaagaggccaacaagcgacaatgggagacaggcagcaggcaaagtgggaggcagtcacagccgagaacactgaaccttatagacctagagagccaatgacgatccaggttggagaccactgagaagggggtgtccctggccactttcccgtccacctctaacatccttactttactgactgccctcaatttcctccattctctgaattttctgcatggctatgtcctaccttctgatctcccaaatatggtaatgtccattcaggtaggtctcactttagagccaaacataacttttatggccaggcacagtggctcaagcctgtaatcccagcactttgggaggccaaggcaggccgatcacttgaggttaggagtttgaggccagcctggccaacattgtgaaaccctgtctctagtaaaaatacaaaaatgagccaggcacagtggcacacacctataaatcccagctactcgggaggttgaggcaggaaaattgcttgaacccgggaggcagaggttgcagtgaggtaagattgtgccactagactccagcctgggcaacagaacaagactctgtctcaaaaaaaaaaagaggtcaaataaatcaggagttctctcagagattacttcccactaagctttgatgtgctacagctttaggaactataactatgaattccgtagccactgcccttcaggaatgtgcattctagatggtttgtcctattagcaagtttcctagctttttcacattttcttttccttaggaattacacactatgcttttgtcataacgttcagcaagcttctcagggatgctataatgacttctcaagttgaatgaggcacactagtaggtactgggaacatacaggcagcatgtctgtccttgagtgttgatggcctttcaagaggctgatgaaaggctttccagccaggcgtcattgcatccagggccatgatcgaaggccactggggagagtgggctggagagaggaagacttaagtgttctctttggagagtctcattgaagtgacacctgtatcagggttctctagagggaaagaactaataaaatagatgtttatgtaaaggggaatttattaaggagtattgactcacacgatcacaaggtgaagtcccacaataggccctctgtaagctgaggagcaaggaagtcaggctgggtcccaaaacctcaaaagtagggaagccaacagtacagccttcagtctgtggtcgaaggtccaagagtccaaaagctgaagaacttggagtcccatgttcgagggcaggaagcatccagcatgggggagagttgtaggctggaagactcagccagtctagtctttgcatgttcctttgcctacttttatcctaggcgtgttggcaggtgatcagatggggcccacccagattgagggtgggttggccagtccactgacttgaatgtttatctcctttggcagcacactaacagacacacccaggaccaatactttgcatccttcaatccaatcaagttgacactcagtgttaaccgtcacaactcctattgacagatgacagcctgacaggaacattcattcctccttctcctagacctgctttgaggccactcatcttgagaacttcgtgctgcctgaagtggtggaggacgcattgcctcctggataacagctgcttgtttgtactgcatacacctttgctttatatgtttggtggagagatgtagtagagggaatggtgacctccaaaaaatatgtccttgtcttccataaatgtgatcttatttggggggggctgtgggggaggaggtctttgcagatgtaactaaggatca[143 bp omitted]ctcctgcctcaccctcccaagtagctgggattacaggtgcgcgctaccccacctggctaatttttgcacttttagtagagacggggtttcaccatgttggtcaggctggtcttgaactccttacctcatgatctgccccgctcagcctcccaaagtgctgggattataggtgtaagccaccgcacccgaccctagtatcgttttaagaagaaaaaggaagagggaaattggagtttcacccccgcagagggaagtagggactgtggacattgaagcagaggatggaaggatgcagacccaagccaaggaacacctgcagccaacaaaagctaaatgaggcaaggcatgattcctccctagagcctctagaggaagtgtggccctcctggcaccttgattttagatttctgtcctctacaactacaggagaatgaagtccagtggctttaagccgccagctttatggtcctctttcaggaaacgaatatagagacataaaacgctggctggttctaaatatgttttccccggaaggtcccagaaaaaagagaaagaaaagagatcacactcagtggagggctttgtgatgatctctaaccccaacatgcgttaggctctgaggtagctgctctgtcatctcctgctgcatttcatccttcccactatcctgtgagcttagtaccattagtgtcctttttgtttttgttttagaggcagagtcttgctccattgcccaggctggagtgcagtggcatgatcttccctcactgcagccttgatctcctgggctccagccatctcccacctcggtctcccaagtagctgggatggcaggcacatggccatgatcagctattttttttttttttaatttatttagtggagacagggtctcactatgttgcaggctggtgtcaaatgatcctcccaccttagcctgccaaagtgctgggattacaggcatgagccactgcacctagccccattaccccattaatgtcctttgatggaaaagtaaagtgaaggtcagagaagaaaagtgacctgcctaagattagcaaataacagggatggtctgtgtgattccaaaaccctggttcattgtgctgcatcccaccatataaaaggcatgcaggctgaaagagatttcctttttctgttgttttattcactcctcaacctctacttcctaacactcttctttttccctttccatacacccacaatgacctgaaacacttttggcttacttttttattttgcatgctttaaggattctttttaatacacaggtatttctccataacagtttatacgcatttgtatataagcatacactacaaaatgattaattgagcgttgtatgtttttatcaaaggaaacaatgcaaagatttctccaaagtgctgtttgactagagatgattaattttaattttcacatgagcggtataatgctattaatcatttaatatgtttaatcataatctctgtaattcctaattaggttcattaaactgaaacatccagcagttatacacaaatccaaatctatgtttccttctcaggataagaaggagctcattttgtttttgcattgaaacgggaacttctaacaggatggaagagaatggactggaagcttagggtttcagctacagcatctgtaaactccgagtctgggtgtagagtactaaaaccccttaacttctgaaaagtgacagttgcaggattcgagctcatttctgtgtcatggacgtggcaccaaacctcgtattctcagcggagaaaacgcaaattctgctctgtttgggtttcagtgttacagtgttgctcttcgactatcacatgaaggcggcgacattgattgtacacttcttcatgcatttgtttattcgtgtactaataattcattcggtcagtgagtgagccaactgttaaacagacatttatcatttgtgttacaagctggtcataccacactcctgctgtgacccttaggtggctccttattgctcttaggatgaagctcagactcttgctttgcacagtgtcctttgatctagccccttgactatctttgaaacctgtcctcctgccttcccttcatacatgcctcatctgaccagtggtgctggagtccacacatactctcctgaatccaagacatcatttcacatctctgcacatctgcacatgcactgccctgtcttggaatagcctcagtccttttcacctcttctcttagacatctcccacttaacgtttaacctccagaattggcaagcctggctgaacctccagcagtgtcatatgaccttgatttaaggttactcagccctttgtgattgcctcttatcccaacatttaccagtctctggggatggtggctcacgcctgtagtcccagtgctttgggaggcagaggcagaggcaggaggatcacttgaggccagaggttcaagaccagcctgggcaacttagtgtgacccaggctctgcaaataaaaattagctgggtataatggctcatgcctgtaatcctagctacttggaaggctgatgtggcaagattgagcccaggatttcaaggcttcagtgagccgtgattgtgccatggcattccagcctgagtgacagagcaagacccaactccaagaaaacaacaacaaaagacaatgacaaaatgattctatttatgattgtttttctctattggtgtcatgcactaaagttggaattgcatgtgacaaggagggctgatttatgtgtccaacacaaagcagttgctcagtaaagatgtgtaaacactttaaaaataagcaaatgaaaacctttccttcgtgtttctcaaaggaggtttatttctctttttggtatttaaaaaacttgccatcattctaaacatttcgtcactttccatttattgaatacataccaggaacttggccaagttagcacacattaatcaatcacaaagcctcaaaaggtatgaactcattattctttatttaccagttaagaaaatgaccactgtactgcttcctattcaatccaacagtataggcaaaatgactaaatacattgtctaaatacatgacttgcacttaaaagctgaagtcaactggtaggtcttttgataccagagcatcttggaagaatggtttgccagctaacaagatgtctttatttcaaaatgcgattcagggtgtgttaggaaggaaaatgcaaatgaaaccttccagtacataccagggctgatgagaaacttgctaattatgcccatgttatctgagtgtttgttttgtatttcactttgtaagattgtcttctctcggtcgttattattttacacctggctgcctacattgatagttttgtcccaattatgtacttctagattgcttataaacaggtcaggatgattcctcactcataaatttgataggcttctgtgtaagctttctatcatagtttcaaagttggtatctgatgtggatggcatttactgccagctggaggcaatagttgctaattgcagagaagtatcaaatgctaaatgtctgaaatgttaaaactctagaaccgagagtatggcagtggctataatgatacctaatgtgactgtgacttttcccctcgttcctgccaaatatgtgggtgtcaatgtaacgtcatgttatacagccttatttggaagacaggggaggtgaaacaatcagttatgctgatgatgttacatggtctaggcaaacagagcacaacagcactttctgcagagatggaaacgttctgtatttgcattattcagtatggaagcaataactacatgtggttcttgagcgcttgaaatgcagctaatgcaaacaaagttaaatatcttgttttaattcagttaaatgtaaattgtcacatgtggtcaactgtagtggacagcaaaagtttgtacaattagaacctcaaaagaataagtcaatcagctggttatttgaactccagaatgccaactagtcttttcacattttttacatttaattatgttttatctgcacaattacctgaacaattatgtaggcatatcttcagattctgaacagcgtcggttaagaaatacacactgtcctgcctttaaagattattacccccttcttgatgaggttctcgctccccacctcccaaccccagcagctcccagtccccttcctttgctttttctagcctatagtgcttttctctgtctgccaacactctatctatggatttattgtctgtgttgccctcatgagaatgatgctccctgagggcagggatttttgtctgcttttcccactgcctaatcccagattcataatgagcacccagtggacgctcagaaaacacttgctgaatgaatgcatgcatgcatgcgtcagcattttcttcccttctcagattgcttagttctgatcttttcctgccactcatggcaagcaaaagagcatcggaagagagcactgtggtccactgagaacctcttcggtttcttcttgttcttttagcagacagatgacgcagcaccgacggatggccagccccagacacaaccttctgaaaacacggaaaacaagtctcagcccaagcggctgcatgtctccaatatccccttcaggttccgggatccggacctcagacaaatgtttggtgtaagtatcacctttcttcccagcagtgcccgctctgggggttccagagacctccctgtctcatgtaagtttggggtatttacaatactaaggttagatgtttgtatggggagaaacaatttagagcctagtctgcaggtatattgtggctagaatctctttatggttttagcatgtatttctgtacatatgctcaccatgtatctactttaccaagtggctttcttctaagaagtaacttgtaggccaaatggaacacaaattcctagatgacccactgttgaaggaagcctattgatggtcctaaatccaatggcccaggacatcatactgcagcaaaaatacacatcgagtcctcttggttttgctttcttttacagttgtcaaatgatccagagggtgactcttagtgtatccctgcattgcctagtctttcccaggcactgtgcatttagatttcagatgcatcagcagagaacaactacttctgcataaagctgattttagcaaacaaaacaaaaccaccaccaccgacaccaaatgagctaccagtttctaagtccatgttgattcctgaagtctacgttcttctgaaatcagtgaaaaggattcagaggtacttactgtggtgctatatgccatgaagtgtagccttgcccaggcaccatggtgaaacacagagcaggccacaagtcaccactgacccaggagaaaataatagcattgctttttttataggtcatcttgcccctgattatttttttctcgaagatatcttcactatccactttgggaagacatgagtttgccatttctttgaccagtgttccaccaaaggacaaagctgtgacagggcttggatatcattcatgtttgcagatgtagccaatttgcccatgacatcccagcaatgatagcaggtgcctctggattcaatgaaaagaactacatccttaacatttgacttagagcaatggtgggcttctcagagactcttcctctaagagttaataaatggatgcaaatatcacaaaaggaacaagaagatgcccaacttgaatgcctcattcctagccaagttggtggtgtctccatataaaatgggaggctcttgttcactactcaaaggcactgtgtgttggggattagcttgcaccttttacttcttatacacacgtgatgcttatcaagtatgcatctgacacaaaagcagagcgagcatcctaatattgaagatacccagctttgaatgctgacatttcagaggaaaaggtcagctcttgcacttttatctctctcatttggtaataaccttgagttgagccttccaactcctgcagaacagagataccctcgggcactttcaggtcaaagatgactttgaaaagtgcagagcattcaaagtgagagtcgaggttaagtgtgtgtgaggcagtaagaccaggtgtgaatgatgggcggtaagaggagttatattctctttgccgtgtcaggttaggaagacatcttgctatgcagtctatttttttctcatcaagtgtcactgtgatgttggctttcaatgtgatccccttaatgaccgtcctgacactctttcatggtgtcactcagttatcgtgaaagttactgcaggctacaatgctaagtcatagaggtattcaaaatattcacaggaatcagagaagggatcctgagtctctctagtcttacagaggtagggtagacggcaaggagcaagatcttgccaaaaaattgtactaccggtcatcagaccttgatccaaatctactagtttcagggctcttgtttttaaaaagacaagttctcactctgctacccaggctagagtgcagtggtgtgatcacggctcactgcaaattcttgggctcaagggatcctcccacctcagcctcccaagtagctgggactacaggcacaagccaccatgcttggctaatttttaagtatttttttttaatagagatggggtctcaatttgttgtccaggctgctcacaaattcctggcctcaagcaaccctcccgccttggcctcccaatgtgctgggattacagcataagatgtgagctattgcacccatccagcacccccccccccccttttttttgtgacaaagtcttagtctgtcacccagactgcagtgaagtggcatgatctcggctcattgcaacctttctcctgggttcaagcgattcttgtgcctcagcttcctgactagctgggactacatgcattcaccacttcactttaaagtcaagattttcaagcaactgacaagatgtcaatttggcaagatgatagatacacttaatacctgtcaattaagagaacacaccatgcatttagtgcacaaactcaaccttgttcatcacaaatagcatctgtgtccctttttttaaaagtatgcaagatttatttgtttctgtaaattttgtctataaaagtgccaggaacatacagattcatagacccccttgcaatgactttcaagcctccttagtttacaaccactattctaaagaaatgcagttttatgcactaaaaatctgttctttcctgccaaacaccggtggtcatggagccgttcttgttataggatacatttagtggcaggaatcacattgtgaagcatctgtaaacattctcattggctccctgcactggagcttagggaatttaggagggtttcctcttttgggtcatagttactgcaagaaactacagtttaactccaattcggtacttctcacgttatttggacatgagacatcttctttccttttggtgctctatcctgtctttgtcttcccactttgacaggggtttacagtgaggacaattacagagaaaaacagtcacaaagatctttgtgcttttccccccctttgtctcttgttaaatataggcatgggatttcaaagtcaaaagcaaaacaagacaaaaaagcaacctccttcttcaaactgcctaaaacttggcagtgatcattacaacgtctgtaaccactaataattcgaccataccatctgcaaccgttacatgcctaatggttactgcagatgactcattttatttctaatttgtatcttcagcacatcatgaagattggaatcctgattaccttttccaccttgtgcttcatattctttactttctactcattggaagcatttgttcccatgtttggcattaaatcttctagctcatctttttttttttttttttctcatttgagatggaacattccttgggcaagatatatggctacagtatacaaagcagaagccatcgtcttttaaaaataccggttgaggttcaagggaatggatctgttctgtgcagtggcattgatattaaatggttcattggaagggatgttagttttataggtggctactttttccttgagctttgtcttcacgttaggtatcatgcatgagcatgcattttctttacagataaatgtttgatgatcccaaaagaggaatatatggatttctaacaaattaattgcgatatattgcaccctaaatagaatgtttaacttaatatttaacatttaaacattctgggtttgaagtgagacaagtggattgtgatatatccagacttctgctacaacagatggatggatgttctggatgccttcacggaattgtcagaaacagttgctcaatgactacagttctcaaatttacacaacacccttgttgattccacagccttactttaggggtcaaaatacagaccctcttggccaggcatgatggtggcttatacctgtaatcccagcactttgggaggccgaggtgggagggttgcttgagttcaagaattttagaccagcctgcgcaacatagggagacccagtttctacaacaataaaatcaaaaaaaaccacaccaaaacaaaatataggtcctctgggcaggaaaatggtccactaaacctctctttattgtcacaaaaaaacagatcacatgactttcagcacatgcaaaggaagatttcaagatcactttttagtcacgagacgggcttgcctgtacttatgacgttaatggaaagttccatctaccatgatgttgtgagtgaagtcattatggggagacagggcatggtaccttctacttctgcattctgaacaggaagctgacactaagaaaaactgggatgatgcctttctttggccttcacgcacaatctttgaactaacctttacttttacgttttatgctgtatccattgaacatccctcacagtttttcagagaaatattgtttgatctgagaacatctaaaaatgcttggtaggtatttgccaaagtgtgtgtgcctgtaagcttctagatcttgtttgttttgttttttaagatagagtctcgctctgtcacccaggctggagtgcaatggcacaatcttggttcactgcaacctccacctcccaggttcaagtgattctcctgcctcagcatcccaagtaactgggattacaggctcctaccaccatgactgggtaatttttacatttttagtagagacagggtttcaccaagttggccatcctggtcccaaactccccaccttgtgatctgcccgcctcagcctcccacagtgctgggattacaggcatgagccaccatgcctggcctggatcctgctcttgatacagctattgagaaactttgtgtggatttgaggcgttgttgaatgcagctgaacattgatgttgagcaaacaaatgctagttatgtctgcgaatgagtcgtgtctatttaaattgaaaatgtgccagctgtgtttacatcattagtagcgaacttcccaattaaactgttgatactataaatatagtacacaactgtcttggaaatggggcttacatcagcattcttctttgggcttgtttcaccggctttgagaaccgtcaacctaacagcaactgccacagaagcaaactttgagaccacttcagggcagctgatgtcattgtttcatttagggaatgacacctgccaagattgctgtttgattggttctgtctcaatcagatcttattttaaaggaaatgtttttgggttgactgcctagagaatgttccatagatgacagttgcatcgcggttttggaagaagtccttttcaagcttctctttctgtaaatatatgtgcttctaggctcttatgcctgaaataaatatgatagcgtctgtggagactgaatattcaagggtggttggtatcaaaattactgcttgaggagttcacaaaactggaggtttctttactatgaaattcagctcacgtttgaatggcaaatccttcatttccccaatctgaatgttttcttctatttccagtgatttttctctgcctaaaactagggcactgaaaatgctctgtaaaggaatattctcttgaccaaaagatctaagtccacagattgcaggatgagtaagctgcacgtttgttggcgtttccattgtgcatgcaagcaatgtgacccctttccatgttctcttctgagtattttctctttggtttcttcctatcctttgcttctctgaacagaagtgctggtagttctttgtttcacaacttgaaatatgtgcgtctgtgattcccccggctgtatagtgtatgggtcctgaggaacgggcacatttctatggcacagaatgacaaacttttggttactttgtcccatagtcagaactatttttatttcaagattgggctgtctgtattcaagtggcatatacatttgtttctactgtttctgggagggtggatttctttgtccattccagaggatagctatctgtatgttctaaataatttgtttcttgaatgttagtaggaccctcttgacattcactctctgtgtctctggatactctatgactgaaacacatagtcaggcaaacctcccctgcttcttgtgtggtctttttgtttgttccttttttatcctgccccacccctcaccccagtcgctctgtccgctgccacacagaagcacgcgtaatgctctccactcaagggagagatggaatacaaaacctctgggggtcataaaggatgcaattaaaatccagaatgcagaagtgaatggaatgataggaaagctcaaaacaaaacaaaaaaagaggatggaaatatttatgttgccctgtttaatttttaatcactcaaagagcatttgctctcattctgcatggagataaaattcccattttatttttccctgggccacagtacatgattttacattaccctctctctcagttgctcgtacttatgcaggttaggctactgtactcaagaaatggccacaatacttcatgtgatctcagaaaactgaaaaaattccaaggttgggggaaaggatttcagatgatccgatgcccctagttctagagcccatacttcctgttttgaaacgtgatcaagaattgcttgatgtacatttctcactgggacttccagatttcacaaatttaaaaaatatgtaagacacagtcgttgaatttgaagttcaaataaaccacaagtattaagtataagtatgtcccaaatgttgtgtgtgacatatcctgaaaaatctgaaatttaaatttaaccaagtgtctgcattttatttgtctctatttataatctgagtctctgtttctggacttttcatagagcctattcatgctagttgtctaaaatctatttgtttaacaatgtggagaattatcttgagagaatttcagcccaagcactgatcacaactgctgataccatcatgatgatagtgcctagatagtggagtttgcttctgtgtttgtactttcttgctcatatgatagagctgctcctagattttatgtgagctaggagccaaccccagtcacatcacattctcactggacattgattatcaaaatcacatttcatcaagggtgtttctcccagtgtttagtgggatagaccagaaggatcattgtatgtacatactagccacttttaatctttgctgctcagtgcctgggaaagcagacatgcacacaggaaaaaaagaaaaatagaattaacctcttgattaatattttgtatcaagccttgccggtatattccataataaggagaaaatatgggtggttttattttctcttgtttcaagcacattaaccataaaacataaaatgtgtatccttggtattaaaagagaaaaaaatggacgtgggaaacaattactactgtacatagtaatgtctactgcatttctcttcttgcttataagatatttctatttctttgcagcaatttggtaaaatcttagatgttgaaattatttttaatgagcgaggctcaaaggtaagcaacttaattcactttagaattgtttagtttatttttaaatgtttgttatgaataaggggaaacaactgcactgtcttaatcagctcattgtgaaaatacacttcagtgggaattcctttagagaccaccttccgttttcaaaatggtgggaaagacatcgggttcagtttaaaatgtataaggggataattttaaattgctgttttatatatatatcaagtttccagaggaaaattatacatgcttaaaaaaataatgatgttgctacatttttgtttttcagtgataattatgttctttatattaaaaagtgagttgatagtctcatgagcaggtaaatatgtgattattctgtattaataaagtgcagttattttcctgggttgtaggggagaaaaatctcatatacaccaaccttttgaatgtaattttattctttagtatgtttaccgatccacatttagcaatttgccattgctttgagtttgttttttcaaggaaaccaatttttaaatagattccctagtgctaataaaagtcaggggctctatggagaggtttgggttcaggagaggttctgtttcaaaacagaaatatgggctgggtgcagtggctcacgcctgtaatcccagcactttgaggtgggtggatcacctgaggtcaggagctcaagagcaacctgggcaacatggtggaacctcgtctttactaaaaatacaaaaattagctgggtgtggtggcatgtgcctgtaattccagctactcgggaggctgaggcaggagaatcgcttgcacccaggaggtagtagttgcagtgagctgagattgcaccactgcaccacagcctcggtgaacagagcaagatcctatctcaaaaataagcaaataaacaaaagaaatatgttgggagaagagaaaaacagaaacatttctaaaacctcctctctatcagtggctaaccaagggtggtcccagaccaggaatatcagcatcacctaggaactgattagaaatgcaagttctcaggctccagccctgatctgttgaattcaaaactcccaagttagggctcagcaacctgtgttttagctccactgaggaaaacaacacatgaggcctataagcagacacagggggttaacagggagaatgatggagaacaaagatgtggatcttggtaaccagaaagtgaatgctttcaatagctctgacgggtctcctggctgccagtccccaggctattaggaattttaagttcccttctccttgcatcctcagactatgaatgcaaatgttgagagatagtgatttcagcccattgactctccttacacaggcgatttgaggcaagtcggtatcacggagggtcagtaagcggtgctggttttatttgaagtgtcacaggccacattgccagctcttttggatgtgtataaccatctttcccccataaaacaaacctttgatttttttttctttattccttggacagccttcctccctcctaagtaaatttagtactaattaactaggatgatgttgatcatatcaaggaaagaaaaccccagtattttctcctccatggccagagtgatgttgtaatctgtcagatgagcaaaaacaaaagcaaaacagaatcccttacactttgtgataatactccttcagggaccttgtcatttttccatagctccagatattttacaatcgttctcgaacttaagtctcttcctgcttcttgtaggaaagttattacggggactattgctatacctgcaaagcaaagtgcattgagagaaaaatgtgcccagcctaattctgttcactcgagccttctgtattcttggcgaaattgtagatgacccgaatgttgaccaacttcgttctgaccctaggtctgtctatagcagcactgccttcaaagatgtgttgttgttgttgttttttaatatgtttaatttatattttgttttgtaacttttgccagttacaatgaagaaagctgtttaattccttctgagagctgttttgggacattagaagaatatcatttgccattttgaaagtacaatggtgatactgtttttaagacatcttccgtcattcccatgattagcctgtctctgggggcttcaggaaaaagaccatttaagtttgctgcatccagagcctgactttgtgaagctgcctttttttggtctttattcttttggtttaggaaacatccaaaatagcctctctcggtgggtatgcgccctctgaaagagcttgtcttgcaggtgttggagctgactgtttaggtactgctggaatggcactgagacagtccagttgggactgctaaatgggggcagcagctcacacagggatatttttcatagttgacattatcctttatgggaaagggccttatttagaggagcatttccattttaatggttcagaaacctgaactgttgctatggcctcattttcatcgtttggtgctggacagacagccaggaaatgagtgggcccttacgagccaggaactcaccttcttgcctttcattctctagagcagttcttcaggcaggccactcaatgctgaaggctgtgtgtgctgggtgtgtgtgtgtgtgtgtgtgtgtgtgtgtgtgtgtgtgtatgcggacatataaacccatatgtacttaagggatggacgcagtgtctcatacctaacattctagccctttaggaagctgaggtgggagtattgtatgaagccaggagttcaagaccagcctggacaacagtgagaccccatctccacaaaataataatttaaaattagctgggcatggtgatatacacctgtagtccaagctacttgggaggctgaggcaggaggattgcttgatcccaggaggtcaaggctttactgagctatgattgcaccactgcattccagcttgggtgacagagtgagtccttatctcagaacaagtatctatattactttggaatatagatccagtatctatattccaggtagtatctatattattttggaaatgtatataactcaagtatttaatgtatgggtgaatagcaagaatgcagaaaatccacattttaaagagatgtcagagagaaaatgagaattcgtaagcatttaggggcgaatgatcctgtaatttatttttcctttttacgagatttacccaaccatctcgtttacctctgatatggtctatttaagggctgtatgcagatatagctactccctacgtatatacttaagatatctggccgtgtgcggtggctcactcttgtaatcccagcactttgggaggccgaggcaggcggatcacctgaggtcaggagttcgagaccagcctgaccaacatggagaaaccttgtcttgactaaaaatacaaaattagcagggtgtggtggtgcatgcctgtaatcccagctactcgggaggctgaggcaggagaatcacttgaacccggggggtggagattgcagtgagccgagatcaagacattgcattccagcctgggcaagaagagggaagttctgtctctaagaaaaaaaaaaaaaaaaaaaaagctacactttgatctttgattcagtagatatcagtaagtatttgctgcatttcatgagagccaaccatgagtaagacagaagtacttcctgtcctcctgggctttcctgagtagcaggagagatggactaggaagatgagtgactgcagtagcctgtgctgttctgcggtgatgggagaggccactgagagtccggacaggcaggctgatattgtgagaaggcttctggaaagaaggaacatttaagctgagagtgagagttgcgtaagaatttcccagggaggggaaagagggatgtgtctcaggcaggagaagttgcatgtgcaaagatcactggagtaaaagtgagatgagagggctcatagtcccatcggaaaatgaatcttcagatgctcatcaacagctcccctcttctaaatatgaattctctgcaccagaaactagaggactggatttttcatctaggatgaaaaatcagtaccttcatccatccagggtgctttatttaagtctttaacatataaaatggtgtatttgcatgaatgcaaaaaaggaagatatcacctaaaaatacaaaagatgaaaaaagaacaataactaggatacaagaggatcagaatgtatgatttgcgaaaatattttaaagtaagcaagtcacgttggtctggcaatcctcttaaggtccccgttatctgccctactgattatacctgctcatgacagggcacaggccaccaatctcttttcttcagtagcattaaaggtaaactctgggaaggtgtgtctctgactccccttctctgtaccccttcttgcggtcttgattttttaagcagttacacatcagcatcacacccagccctttgccgagcaagccaagctcagaatgtgcttgttttgttctcctttttaaggcagaggtaaaaatattcatcatctttttaaaaactgcaaattgctgcttccctgagttagaattccgaccatgaggcgggtcagaaaaaacaaccttagcacccgctctcaaggttgcctggcacctgtgcatcgtggcaaaggttccctgctcatagagaggaccaggtgaggtctttctggttacattgcaaccctcaggtgagaattttgataacctgataacccagggaggccatgccacttcttgtctgggtgggaggtagaattgcccaacggaacaggtaggaaagtctgtctggcattttgaggaccgtctggagcacattctttctgcaccgaactttgtcaaatctcaactctaaatgaggaataccaagtagctgacaagcaaagagagaaagaagtttcgcagaaaaacaatgagaataataaaaaagaatgtattctctttgcttaaaaagtgagaacttgagaatagatgaggctatttcctttttagttcatgccccttccttgggattcaaaatgtatttctctttccacctttgtctttcctaaacatacttaatgctgatttcggggcagtaggtttgccttgggttcagacatgaagcatgagagcaaggttctggagtataatgttggacaggagggtgagtgttcagtctcacctggctgtgttcttcccagtgctgtggtaataatgactgctagttccaaagggcagaaatgataccacctggccctccagctataccagtggggctatggattttcttttcttgccgggagagaatataaatccaaagccctcgtttctctgattctttttggaatatgtggcatggctatggttgctaggaagttaggcccatcagggaggaagagaacgttgccaagaagcctgggacatgtgcttttggctgtacctctacatgtaagctccaagtaactgagtcaaaatctatagccaaaaatctatagatatcagcaatataaaattctatttattacaaaggatgaaaacctctttttcagatagggtgtcacccaggctggagtacaggggtacaatcacagctcactgtagcctcaacctcctgggctcaagcaatgaatgctcccacctcagcctcccaagtagcagagacaataggtacaggctgtcacacctggctttttttttttttttggtagaggtgaggttttgccatgttactcagcctggtctcaaactcctgggctcaagtgatcctcctgccttggcctcccaaactgcttgcattacaggtgtgagccaccatgcctggcccaaaaccttcttttgatggtttcgatcacacgtagtgaaatgagaggtcatggaaatcaaatcactgggccacacattttaagcaaacacatttctggactccagtctgggattctaatccagtggatacaaagcaaggctcaggaatcttaatgtttaatgtcctcccaagttccttctgatatgcggctaagtttgagatatactggccaagagttagaactgtcaaatagagcaaaatccccctaaattctctcttttttccctttgaagaacaatcatttccaaactatacagttggcgagtgtatttgcatacccaatatgggcatactttgtgcacaagactaagcaagacccttctgttatggagcaaataatcttaaatgaatcagataattcaggcttatcctaatcacagagcctcactatgggaaagattatggaaggtaatttggttcaatcccctaaagtaaagaaacgttatttttctcgatacagttcacccttgaacaacacaggtttgaactgtgcaggtccacttacatgtgaattttttttttttccaaccaaaggcagtattcccaggatgtgtggcctgtatatatagagggctgattttcttctatactcacattccacggggtgactgtgggacttggaaatgcaaggatttgggtatcaggggtggggatgtcttggaactaatctgtagtggattctgaggtacagctgtctatagaatcccgacaaataatcatctaccctcacttgaatacatccacatcccctgtcttctgtggctgatgagcctattccgactgttgaaaagttccgttagccagcccattgcacaatactttttttgttgttttattatactttaagttctagggtacaggtgcacactgtgcaggtttgttacataggtatacgtgtgccatattggtttgctgcacccatcaactagtcatttacattaggtatttctcctaacgctatccctcccccagccccccaccccgtgacaggccctggtgtgtgatgttccccgccctgtggtcaatacctctttagccttaaatttggaggtgattatagagaactaatgtaggactgggagttatcaccagttggttataactaccatgtatttgtaattattgtgcatttctttagtaaaactaagtattatactgtcccaactcaacttggagccaacaaggattatttgatgctaagaggagccccaacatattgcatgatttcacccagtttacagtgaaaaatctgaaagagctgggtaaatttatgtggaaattgttcgaaaggttggtgtatatttctgaacaagatgtacaaatatttttaggggctttaaaaataatgtgtcgtattttctgtacttaggaacaatgtcagtgaagacaaaatacggattttgacaatatagtttagtggggttgatttttgaggctgaaatattaaaagccaatgtacctgtggtaaattaaaaggtatatatgttatctatcagtaaaagaggaagtggccagaatattattacaaattacattctattaacaaagtttctttgctacctgttgatatgaaaaataaatattgacctaatgccagaactttacaatatgggtacacctttccctttctggttaacaaagtaggatggaaggttgtcaaattcaaaagcgtgtatgcaatttgaagagtggggaaagtatgagcacaaacattgaattgtttgtattattaatcaactgaagtttatttctgttcatttcatgtgacttttttgtttattagaccaaagagtttaagatttattataaaaaaggtctttccttttttaggcttttaagttttatttttgagaagtaaaggctgtagaactgacaaatttgaataaccctaaaactgcatgaagaagagatgttcttaaaaccacacggcatgactctgtaggcaatgttagaggattttggcattcattgttgaatttcgtgcacacgttttattttattttatttttaatttgcatgtcaaaaaagtggttcccttttcttttcctcattatttcattttattctctgtgaagacactgtaaatttattttgatctcattttcttttcgttagatttattttcttctgtagtgacatttagaaaggtatttttggtatccttctttgaatacttcaggggttacagctaactggtgacagaaaaaaatatcttgttcacatttgtcgcttaattattgcacatctcagtactcttataatttctctaatttgcatgttacagaactgaagccaggacaagaaatagaaattaaagcgagagaacattaccaagtggtcgttgactgaaataataatctgcatgttgttttcccttctccctcctgcatgcagggatttggtttcgtaactttcgaaaatagtgccgatgcggacagggcgagggagaaattacacggcaccgtggtagagggccgtaaaatcgaggtgcatgttcaaaatattttccttttcatcttttttataaatgtctgcttcacgctcattcgttgttccagatgcatcattggcgtcttgtatgtgaccctattccccctcattgtttatatatatatatatatttttatatataaaaaggaaaactggccttacttttttttttaattttactttattatgttactcttataccgctgaaaggtggatggcaaacgtgagacaaaagaaaggttaatcggaaagtgtttttttgttgttattttccatgttttataatcaatgggtgcagtaggttccaaagaatagacagtattgcaaaccaaacaaaatacagaacagtttctttttctttttctttccacttcagggttgaagagggatccacagtggttggcaaattaaaccaaattgggaaagcaaaaaagattgtttttttgtttgtttttttttgtttgtttgtttgttttttgtggaaaaaaaaacaaaaaaaaaaacgagaggtttttactaaacctctcgtttttttttttttaagaagccagtttgaatttctgtattcttttgataacaaagtgaataaccaaacaggatttcctgttcaatatctggcccctgttcactgaaagcataaataccaaaatactgacattcagagtctgctatttgtcccactgggatctcccgcaacatagccacagggtcatatttgttaattttttttttaataccagttacaaatgctttagtctttggagtaagatgttgcatattttgcctttcattttccccttcgacgataacgcttaggcccctcaccaaactctcagtaaccatggtaactgtatacaaacccatgctggcgatggtggtgaatggtaagtggtgaagtccatctgccgtttcacgtatttagtgctgatatatctatatacatatatatatataccacgtgaatttttttgacttgtcgtattaagttttcttgatgctctatttttttggatattggtacgcctgtaattgagtgtacgttctaagctagcctgggaggcactgactggattgagttatgaccggtgcacatcttactcagattgttaaccccatattgtgttaaacaatgcaccctctcttttatccttttgttagctgtgacgttaaagcttgaatgattttgttaattcttgcgatgtaaaaggctcttgttccaagtgttgaatgctagatgttgctttcctgatggttctttcctcctaaagtgttgcacacggctaagacttgtttgtccctttttttgacatttatgttcccttgtaccttgtctcttctctcttctccactgcatgctccttcatatgaattttattttatgtttaaaaaatatttcttgtttctgtgttaccatggagtacacgcatgcttttaaatcttcaattatgcagaatcttttaatttgcttttactgtccctttattaaacactcttaatgatatgacattgctttattgaaatgatttgtaagttaaacggttatgaagtaaatgtaattttaaaaatgtatgattttgttatgcacctactgccttttataaattaaaatgcattttactttttagttttcttttttaataagtaatcacggtcataatgcatgcaactaattgaattgggagctggccctagaatatgtgcttacttgagttttctatgtacataggtaaataatgccacagcacgtgtaatgacaaataaaaagaccgtcaacccttatacaaatggtaagtagagattggccttttacaagaaattctctctacttctgactctttaagtaatttaaccagagattctattacaacaagctgtgtttgcctgggcattgacactgtgtttttactactgacctgctacagtgaaccacctacatcaataagatcattttcacaacaaaggcaaatggagtgttcaggttaagtgtgcctgcccttcttcccttctttctagaataactctgtttgggattgagatgcactaattatttggaaattagtttgctaatttcattggttattacagtaagttgaggggagaattggaggtttagtttgtttgcttttcaataccatctgctcgttgattactaatcattcctggacgtgcagtcacgtaatttattctgtctttgagtcttctccagagagattagtcatttgaagtggtttagagtatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggatcataaagggtctcataattaaaaaattgacataaatgtttgtcgcataactttagataaatgatgataatatgccagaatgctaatggttgtgctgaattgtgagactggcaaacattttttctttgattcaggttcataaaaataatataactttattacatcaaaaggagatatatggaattttatacttctaaaattttaattgcacatggagatacggattttttaaagtaaaaaaaaaattaaaagaaacgttaaagacaagtctaaaatatattttaaataaccccattgccaccctggtttcctacctcccccctcacaggaagccgctattacagattgttgtctatagttttattttgcgtattcatgcctatatatgtagtaggtgttcatttatagtattcatagtgttgtatacatttttatgtgaatgatataaggatacacctggcatttttaattgggttttttaataaatctatatagagttcctttaatttaatatatacagattagactaattcatttcagtggttatgtaatattacacaaaacagataaataggttcagtcagaactaaatactgattgtttatcacaataaaagaaaacaatgatctagcaatgtattatcatttggtagttttgattttcctgtttcttttgccagtgactaccaatttgacagtcagtttgctcttaattttaaaaggggcatcattcaacagggacataccgtctatataatagggctctaagttgaaagaccagaagaattacctattctgctatttttctcagctttgtcaaccaagacatgcccttaaatggtatagactattttcacaccagactttaaatgcccagtgctgaactgaagcaaacctctgatttatatgtcatacagcctttccagttgggtaaaagtaatgactctgaaacttgccagatttcatatatggtgacatcaacctgacggttgggcatagtctttaattatgaagttgcactggtgcccaggcacatgtgtgcttgtctacatatgactagctgctcatgtgtgctgagtgagaaactggagcgagaaaagccaaatatttcataagccatgtgcatgtatatttattttaaaagagttattgatcaattttatgaccagggactgaaaactagacctgtaggattttttaacacaattcaaagcccatttataaataactagcctttctggaatatgaggtatgcattatgtgaggcattttaagtgcactggacacaaatgaagtcctataaagaggacatcattatccctattttagaggtgcaacattgaggctagagaagatgaagaaattaataaagacttttttttttttcttttttttttttgagacagggtctcactttttcacccaggctggagggcagtggcatgctattggctcattgcaccctctgcctcccaggctcaagcaatcctccctggtagctgggactacagccacatgccacaatgcctggctagtttttttttttattttttgtagagacggagtttcaccaagttgcccaggctggtctcgaactcctgagctcaagtgatgtgcctgtcttggcctccaaaaatgctaagattacaggcatgagccaccacttctggcctagccttttctttttgttatgaagtaacaaaatcttgtgaccatgcctgtgtgtatcaggcatcgctttccctttgtcttcttgtagaaatgcactcaagtggcaaccaactacaataacaaaaaaattattaaatgtgcaacctcgtgttcctgccagattttggcatgcacatcccatgtcccattccaggtagccatgcactcagtttccaggaataagtcagtcatatgggtctgtcatccacgtacctgcaaaagggaactcagagaattgttcctgtcacacatactgtgtatggcacctaaggggttgatggatagacacagtagaatttatttaaaacacaaatgtcaattctaattatataaagactttggcttctgtagtggagattatggagaactttggtgttcaaagaaaagtagttctccaagctatcccaagtttcaactcaggagtatcaccactacagataaattcccttaagtggcaatacaatataactgaaaaaatatagggccctttcatatccttaataagcaagacgatagagttatggcaaaagagggtaagtcgggaccaataaagtcacattgaaatgagaaaattaagccatcggtgaggttcactcattagctacataattcattctcacaaagcatagaaattgtacttcagcaaaattataaattactggagctatcaaagtttcaggtcatctccaggtgatgaaatatagttatcaatgccagcatcaccttcatgcattacttcaatcatgtatccagaaaaacttttagcagctgcaaagtttccagtgataaataagactgaattctaaatgtgatgagatacctgtccattatagagggttacagttaataacatggagggtgtagatactattctcaggatatttaaacaatgacataatgaaaagctgtagaatgagccgtaggcttctggacattctattaaaaagttccacaaagaggggattggactatttctctattgctatttctctgaaggacacctacccacacggaggagttggggtttgctgtgttctttggggatcaaatgttggatctgcaatacaagattgagagctgaattcacaaggatttcctggatgctggggaagcatgggtgctagacatggctttttcattttcttagagatgttaggaaggatgaaaatggggcaaacatattcagcgctccagagagaggcatactttgttgcccggatcagttcttccattcactggctcttgaattgtaggaagttgtttaaactctccatgtgccagctctctagtgggaactgtacaaatgatgggaactacatcacagttctttgtgataattatgagagaaagtgctcaacacaatgctaggtatgcaaagtggcctaaaagattatttttactactatttatagcgcagtagtatttgattacacatagtttcaatattaagtcatcatattattcctttattgtcatgggtagttgaattccctgagagatactagtttaaggatcaattcttcagatgctaaaaggggctgaacaggtaaaatcagcaaacagacagtctttgaaaaactcagtcttttgggactagctattgttttcttactgaagtaaagcaaaatatttatctacgaggaaaaatcaacaccaccaccaccaccaccacgaattaacaataaaagatctcaaacatttaatctccctatcagtctcacaatggggagcagtggtaaatgtgactaagtggggagttgaatgcagtagcccttgaccacctctaataagtctgtctgtgaggcattctcaacttaaagttaccatttctaccgatgtttcaagagaaatagaaatcctgtattttagacggaatttaaattttggcaataaatacacgccgttaaagaatattcagtgaacccaaacaaaacacctttgtacccagtgcgaacctcacttctttttgtttggtatttgagagttgccacctgtaccatgtcagctgccaggtctctgacatccttagtatatgtctttagaaagcattgacaggcagtttttgtaattcctgtagcgtacataagggtgctctctggaatgcgtttctttgatatgtaacccagcaaagccttaagagaaagcctgtgctgatgttttttgtgtacacattcagacttggccttttaacacccaatgcagtcatagttaacactggaggtcttaaccagcatattttagaaatactgacacttgacctttgacaagctaaatttggggaggggagtgcaaattcagatgtggccccttgagtcctggccacggaggggtctaaactgcttgcgtatctgatacagagccagaccccaagacgtctgttctctggctccattgccttgttgtggggctgggggggccctgggaggctgggaccagtgggccttatcagccattctccttttgttgtaagcctcattgttcagtttaatgtccttgatcaaaatctctgaatttgcaaggcctggggacatacacaaactgcctaagaaattaaaaaggggatcattttgttcatcttcctgacagtgcaggctcttatctccagcagggttatcccaagggtctctttcaggtacgaggaggagtcacagggaatgtgggttcatttgcatgtgatttgcatatatttacataagcccgcatgagctctgtaagtctgagtggaggcgattttcaagggctggattctagaccaaatggacataacagacatttacagaataccttttccaacagctgcagaatacatcatctactcatcaacacacggaacattgtccaggataagccacatgtcaggccaccaaacaagtctcaacaaatttttaaaaaatctaaactatatcaagtattttcttagaccataatagaataaaactagaaatgaatagcaagaggaacttcagaaactgtacaaatacatggaaattcaacagtgtgctcctgaatgtccattgggtcagtgaaggaattttaaaaattcttgacataaattaaaatggaaacacggcatgccaaagtctatgggatacagcaaaagcagtgctaatcaaaaagtgtatagtaataaacgcctacatcaaaaaagtaatttcaactaagcaaccgggacaacagtcatccctaacacgattcttctttatttaatgtagagtctatggaaggaagcaggtccttgaagattggaaggagacataatcagagccaaaaaaaaatttgtctattaggaaaaactatattcctttagtttctttagagaaaaaccaagtaaatatttatggaatgcttactttgccaaacaacattttaggtgctggagattcatgttggacagcagtcttgcctgcttgactgttaattttaatgagggagaatggttataaaagacaagagcaagcaaagaaagaaagaagctaaatccagatagcattaacggcaatgcagaaaataaaactgggaatggaatcatggaatccaagagtaactctaagaggaggtgggaaagtgacattaactggcatgttctgaaaagactccagagccctaaataacatgaagtcgactttgtgaaaagctagagagttctccaagaagaaggagaagtggatacaaagagactttgatatacggtggtcttggggggttttataaagatgaaaatggccagtgtcactgtagctgggagagacggggaaagggaaaaagggaagtggtaccaaagaggtaccaaatagtttggttaatggttagtgtgtgctgattgactaaggtaagacatgtgtgcttatctcaaattgggaagaagctattgaattctgagtatcaggatgacaaagctgatgttttttttaaaaaaattgctttggtcaccatgaccagaatggacagggggaaggaggaggaagaggagacagtgagaattagggcatttctgctgttgaacttgtccaggcagagataggaatgccttggtctgcagtggtggcaatggagaagaagggaaggacttttcaagttttaaccaacaggattttctaatggatcacacatggggtatgagggtaagagaagaatcaaggaagtgttgatgaattttattttgagcaaccaagtagatagatatgccatttgctaaagggagaaggacttgctgagtaacaggtttcatgagtggggggagaagagggagactagaaattgggttttcattcccatcgcagagttcagaaaggtctttggtctccaacagtgggagtggagtagccttgtttagaagggatcaaggatgggaagaaggttgacacctgcactcatgttcccatgatgacccaagcatttcattttgcagcacacagattcccagctggtttcttgtagaggagactttatcaattacctttctcacgattaatacttgcaaacatgagatagcacagatctcctgatgaaggagagtatcatttattttctttatttttttatgaagagattgccatgtgcagacttggcaaactcataacttgcagaaagatggggaaataaacagcagattatagggggatagacagattatagatacgtttatagatagatcagtagatagatggataggtgggtaggcagatgagataaacatgatttctaggtagcctcaaatgcctctgagagatctggaattttttgctttgttcttagaaaatgagagatcattggcaaatttataatctttaagagctacaccaaaattcactgataagtataccttcagtgaaaaggaaaaggaagtcttatatgcaaaagaaagtatttaaggtagtaaggatattcaagaaacaagacctgagatgcacagtatgggaaagacaccatctccactaccaataagaggtaggagcatcagtagagtatgagatgggtaacagtggaaagatgaagagtgatcacttaataattattcatttaatatgaccccatatagagtttacaaattctaggtttctgtgaaaaactagaaagaaagaacattaaatatgtctgcagctttattttcaactagttttttgtactttttcttagactccaagttgaaatgtagatattaattcccatatcctcaggaattagacttttttttaaaaaaaggaagcagtggaatttcagttgatcaaattgaagtcatttccatactcataaaacacattctgaaatgtctgaactaatatttatttttacgtcactatagaaattcttataaggcaagatgtgattaatacaagagaagagggtgtcagtatgaaatttcagaaaccgctagggcagtaggtctcagaatttcatgtttctttctgtcactctaaaaagggggcccaggaattaaatatgcctcccaggtaatagaagtataacactttgagaatctctattctgagatcatcccgggggctgtaaaccacctagcttcttcaggttggaactgaaagttcttagaaaacattcttatcaagttttagaaagttctggatttcgatagacatactggcctgtctgttgagttagtgagcctctgttttccttagtggatgttaagaacacctctgggctattcttagttcgggcagaaaatcacacctctctcttctcggcaaacctcagaaagttcttactgtcaaaaataccttccttcacattcaaactttaatcattgccttctctcaaaaacatttattaaaggacctttggtatttggccttctgctcaaggactcagagcaaaggactacacaccttaccctcctctgtctttcaaggttttttttacttcttgagacagagtctcactctgtcacctaggctggagtacagtggcaccatcttggctcactgcaacctctgactcccagcttcaagcgattctcatgcctcagcctgattagttgttactactttgtatttttagtagagtcaaggtttcgccatgctggacaggctgctctctggaaactcccaacctcaagtaacctgcctgccttggcctctcaaagtggtaggattacaggcatgagccacggtgcccgacctgcatggattttttttttttttttttttcccgagagagtctcacactgtcacctgggctggagtgcaatggcgtgatctcagctcactgcaacctctgcctcccaggttcaggtgattctcctgcctcggactcccaagtagctgggattacaggtgcccactatgatgcctggctaattttttgtatttttagtagagatggggtttcactatgttggccaggctggtctcaaactcctgacctcgtgatctccctgccttggcctcccaaagtgttgggactacaggcatgagccacttcacccagcccgcacggatgcttttatgaagacttagccagcaggagcaggaaacaataacaaaaccctaaaacgtgatcagtctctggaaattgttcccctaaataatgcccagcatatatgtaatgtgctttccaatttgagaatattcttgtatgctctttttttgtgagtaaagatttctaaagggtcaggattcattttacaaaaaactctccatccagaacatttggaaaattacaggattccattaatcatatatacagattatttgaaagttaccttagatatcatacattgattaagaattttttacagttcctgaatgcatcaaaatgtaggccacagtaaatctctaggggataaaatatcattttctttggtttttatgaagcactttggaattctctagtatctcgaggttataatttggaatgacaattgttagaatatattgctgccaagaattttgtttatgcaagctttctaatttttgtgaacttaatgcagaggggtgtgatggattatctagcagtgatatataaaataagaaaaaattaaaattattatagtagttctaaaaaatattgatggagtagaaaattaattaccatgtcattttcaaagggttcacttgtggctggtcagtagtttccattccattaacttgcactggcagaaaatcaaagaagggcataaatatattttcttatgtgtggtttttaagtatttttatgcatgcccaaacgacacctcctttacattttaaaatacaaaatgagatactttaacccatttgatttgtgattcatttgcaattatataagatgttgaatcaaatgtgataataatgtttttgtgtatttgttttaaggctggaaattgaatccagttgtgggtgcagtctacagtcccgaattctatgcaggtacagagtttctctttgcacgaagtcttctcagtcttttctaaatgtgctttgcctgccaagaatgaatgagttttgtaaaataacctgaagcaagtgaattcctatcctaacaagttctgaatgatttctttgggcaaaatcaagagtgcttaaaacagtttaaaaattacaagggaatcgtctaagtttcatggttgggggatcagcgtggagccactgctccttaggacaattcacattgattttgccctaaaaaaagcattgtgactttgttcaatagtgtattgaacaaatggagagctgctcacacccattgtatttcaatgtgcctgaatgtgtgttttagccatacatttccatttggggttggcattttctttttcctggcaaagcagagagtcgagttggcttaattattccaataatgtgggagtgatttagaattgccaagggaaggcctttttcgataactaaaaagttgtccgtcttcgttcattaatcaaattcccttagcaattccttttctctctactttgccttccagaatatgtctctctcctcaccccttccctgcctaagcaccaattacctctcagctgggaaatccattctcttagaaattttgggagagcataacccagaagcagtagtggctgagatttcatgtctcgatgtcctcggcttggcccgtcactactgcctgtatgtctccttgctcttgaacaaggctgcattgaatacctaggaccttagtaggtttgccacatggctatttaaaagaagtctttctttgatgtggctcttgctttttaataaggagaaataaataatccgttgacctagagccactcccttagtaacctcttgacggtaagtcataccccttgctttgtttcttcctgggctgcctaacttttgtcattttcctaatactgaacactgacccttgtagatgagaaaggaacacagaaaacttagctactctggcacaacaaccagtctgacaaaatttaagttaaaaatctggtaaatctggaaaggctcaacaggataactgattcctggattttacgtaggcgatgtttggagttgttcttcatgtatgagttttaccgggagcctgggttaagtccagggattctaacactgcaaaatagctgtgttcactcttgtgggggaagagacttagccgtcaggctttccatgatcatattgcaaaccctaccacctgagaagacacctctgctgagtaaggaacatggaaaccatgcctacacagctcgggttcaaattctgcctcccctactcaccagcagtgtgactctgggcaagttacttaacctctctgtgcctcagtttcctcatctattaaatggagatgatagtaacaaactcatagtaatttattagaattaaatgggttaatatatgaagagtggtgtgtagccagcaccgtgtaaacatttagtaaacaaaaatgaatatgttaatctctttaccaggaaggcaaagttagctgcatattctgctgaattttgagtatgctatgagacaaagagattctttccttcattgatgagagtactagtccttcagttctcagtgtgttcatttagggggtgttaatttctgggatcgggggcatggcagtttattcaggggacacacagaacatggcatgtattgctgggatgcatctttgtgcaaagctgcaaggaaatcaaatactccaaatggttgaaaagtcagacaacagcttccatgtgtccgcagcaggcactgcccatgaatggagtagttagactaaagaaatgtcagtttctcctatatgcacatatctgagtgcatattttcagcctaaaatagtccagtgaagaacaagaagccttcttgtggggaggaagggtatggatgtgagtgttgtggtggagagggcaaaatgcatttttacatttttctggtcctgtgcgatggagttgccagtcacccttgggtctattaagcaggaaaatacctaatatccccgttacttgtgctttcgtagccacagacatatctgtgggtgttgaggaggacattaagatgagagaaacagttaagactgatttgtaactataagaataaattcatctgcatgacttctagaacattagagcagctattcagattagcccagggcccaggttcagaagttagatcattaagttagaggaaaagaaaatgttataatgtaagttaatatttactggatactttctatgggccagcactgttctaagcactgtacataagtttaatgtatttaatgctcatggcgattttccaaatgaggataccaaaatgcaaaaagttggtattactgctctgagatttcagctggtcaggaggaggccagattttgaaatcaggctttgatcatctcagaaatcgtgttctttacaaccagttgatactggtggggttttgtttgtttgtttgtttgtttgtttgttttgagatggagttttgctctgtctcccaggctggagtgcagtggcgcggtctcagttcactgcaagctctgcctcccgggttcaagtgattctcctgcctcagcctcctgagtagctgggactacaggtatccgccaccatgcccggctaatttttgtatttttagtggagatggggtttcaccctgttagccaggatggtctccatctcctgacctcatgatccgccctcctcggcctcctgaagtgctgggattacaggtgtgagccactgcgcccggccccctttttttttttttttttttttgaggcagttttgctctgttgcccaggctggagtgcagtggcatgatctcgactctctgcaacctccgcctcccgggttcatgcaattcttctgccttagcctctcgagtagatgggattacaggcgtccaccaccatgcccggatcatttttgtatttttttgtagagacagggttttgccgtgttggctaggctggtcttgaacttctgacctcaagtgatgcgcccagcctgtttatttatttttttttttaatattaaaggtcatgattccaatcgactgtctcctatgatcatgctactgctctgtgtgcaaaccagtgaaataaaagaagagaggtaacataatcattctgtatgattccagctgccaccaccaccaccatattcacaagtgttacatgacaaatctgagtatctgtgtttcatgctgccactatccggattatccggaaaatccacatgctttcctcttttcagctgtacgtttgtatgtaggtagacagagctcataatattcagaaatgtggggacatgtagctgtaattttaacactgcagagcaattcctttgaaatatttgaagacctgcaaacactgaaagtctggctggcttaaatctgaagtttcaggcacctgcatctatggaatggacctatgcaaagcgatagatgcagagtgcattcatttccatatccaggtataattattactgtcacgcatctacagatccatgactaagaatttatggggcatttaaaatttccccagctataaaaatagtctgaatttatcttgcaattctgagtgtgcctcaaagctgaaatgaagaccccttgtcattgatttgctttgtatttttagtaggctggctctgtatctgcttaagatagaaagccagacttattagtcatttctctatataaggttgtgtgttaatgacatgttttataatattctcatagtgtaattatttgattttctgaagcttatgcagaattaacaacccagcctcccgttgtctctcagaatgaggcatgaaaagttcacatattttgtaaattaaaatcaatattttcaatctctcctaaaggtaattttcttagtttagtagacttgtccctaacatttattttctcttttaattataaaatggcaagttattgaccaggcgtggtggctcacgcctttaatcccagtactttgagaggccgaggagggtggtctcaggagttggagaccagcctggccaacatggtgaaatcctgtttctactaaaaatacaaaagatctagctgggcatagtggtgtgcccctgtaataccagctacctgggaggctgaggcagaagaatcacttgaacctgggaggcagaggttgcagtgagccaagattgcaccattgcactgcagcctgggtgacaagagcaaaactctgtctcaaaaaaaaaaaaaaaggcaagttattgatttttgtatgtaatgttttgactccccgagtatgtttttattgcaaacttgggtggggtgggggcgaggcaggaagagccattgcacttaatgaggacctttaattactatttgcattgataaattatgacattccttctccctcacacgtgccttccagaggaagcattgagaacgttctaatgtattttggatggtttttcttttctgaattctcatcaagtcatacttataaaaatctttctaaatgcttattccgtgccagtcttcagagcagatacacatacatcagcacatcccatgacatatattaatataaaccttctcccaggagagatgggtagttttctataaagcaaaaacagcattgataatttcttctaaaatctaatcatctccagagtccttgaggcttattcaagacaaatgatttgccgggcgcggtggctcacgcctgtaatcccagcactttgggaggccgaggcaggtggatcacgaggtcaggggattgagaccatcctggctaacacgatgaaaccccgtctctactaaaaatacaaaaaattagccgggcgtggtggtgggcgcctgtagtcccagctacttgggaggcagaggcaggagaatggcatgaacccgggaggcggagcttgcagtgagcccagatcgcgccactgcactccagcctgggtaacagagcgagactccatctcaaaaaaaaaaaaaaaaaaaaaaaaaaaaagacaaatgattgtaagtccccacacacaaatccaggtgagtcatgaagtctttggccaatgtgtatggcccttctttagagtttaagtaaaatcaaggcagtaaggagaagtagactcagaatatctctacccagtagcaggcctcatgttatctagtgtagttaaaaatagtgtttccaagaatgtggaggaataggcctcagaggggattcttacactttctctgtcattgtgagaatttcccttgtcttctaataaaaaaatatatatatatatttttaaaagcagtatcttctagagataatcacgatatccagccaatgaaactgttgatttacggcacctttaatcttcatgaataagtaaagcaaaatcaaaataaataacagaaggttacacaaagttgtcagcacggggctgtcaaatggtaaatttatctgtttctcaattgccagtaaaatacacactgcaaagctcacccacgttgtatatcatatctgccaactcatttctgtgattaaatattccatcagcgggactataaggcagcaaagcttaacaagattcataagatgcaccacttgaacacacataactcacttccgtggatggagagcaccccgcctgcaaagggaaattggaattgagttaaattactccatgagacgtgatcaatagggaaaggcaaagatcttctaacggaaatgcagatctaagatatagttaggtcccagagatgagatacatacaattaaagtaaaaataaggagatgcagagtagatcaacttgaaaaccttgaagaaaacaaaaaccacccctagggatatttattattagtggaatttggggggaataaagagattctgaatggatactcctgaaaagaacaatttgtggttttgagagggaaaagaaaatgacaggaactaaaaatgcgccatgcctgactgcaaagtcacatttgaaaggtggtcaggtcttgaaacaagctcaccctagggttacaggggcgatcagataatatgagcatcagagaacatcacagactgtaaaatagaaatagaagagattcatgtgatcaccaaagtcacctcgactgattatatccatttcagaaagaacctggccacggatcacatgacttgatgctgggctaggtgatgggaaagtggatttggatctcagtatgaagtttaaaaatgaagagggtggttataacactctttgattgcttatctcaaaagggcaactgtatttgacctcggatttacccataccaaaggtattggttttctgtgggctagagtgaaccatgattcatctcagaattgggtcaaaagaaggtctatgaaggctccctcacattttttcctcccacttccaccaccaagagtctattaccgttaagagaatgacttttagtcatacttttagctgtacctcttttcaattcccttcctacaatttggatacaatagcatctgagaaaagttaagattgtctagaacccacctttgatcactgtggtccctgacacaagtttgctctattttattcagattggcattgggctcagggtgatttggctataaaaagtcctaggtataaagcatgccctgtttgggatgaaagagcacagtgtgggtttacaaggtaactgttaccatccaagcccttcaaagcagcaaatattcaggtgcccctcttggctccaacactttctcatacccaccaggaggactagactcgaatcaatggccatagggagcagttcctcatgaaccattgacctttggctctgggatgttttgcatagtttacgcatctgccaaattcaaatgcagtgcacttcagtgaactggaacaggagagtccagatttaagtccccgagcaaaggattttcagcctggaaatgttccacttcaaagagtttatcttgcacatctgtttacctttgcctccccttttagttgtaattcacttcgcttctctcctctcctcccctcttctgtcttatcagattttattccagccctgcccatatttggccttaatttttatctgcgtccttctagatcccacagagggaatgcaactcatctttgatgaagcctgtggggttttttgatcttcagataagatcagtacttgcttatgtgctaaaaactgcatttttgaagtaaattggttctttttcttgtgtgtgggaagtctgtcaagaactgctccccccaaaagcagggggtgtcaaggtagtccttgtacaagaagcttcacatccaggctatgggaagcgaatgaggtttggatatccgactctggaaaaatttcacaggggaagttttaagttaccattgtccacatagtgagaaactcaaaccatcaacaacagcaagccacttgcaggtacttgctctgtgctgaacaccttgtttctcctcaaatccttatgaaaatgctatcccattattttcatgatcaaattatgaagtcaaggtttctgggaaagcttacctcattcgccaaatcacagaactaccatgtgaaaaattctggttattatataaaggtcttttttcctaagtttcaaccccatgttttttcactgctttgctacgcagcatcctcaggaggtgtagatgagggcatgtcctcagtgtcttctattcatgaggtcacagaatataataatgaatgaaggccgggtgcggtggctcacgcctgtaatcccagcactttgggaggccaaggcgggtggatcacgaggtcaggagattgagaccatcctggctaatacggtgaaaccccatctctactaaaaatacaaaaaagtatctgggcgtggtggcgggcacctgtagtcccagctactggggaggctgaggcaggagaatggcgtgaacctgggaggcggagcttgcagtgagctgagatcgtgccactgcactccagcctgggcaatagagcaagactccatctcaaaataataataataataataataatgaatgaaaacacatttgcatttaatattgtctgccacatgccagagttcatgttgagaactttacatatatgtacgtaaattagaagttttcaggagaagtattgttaccttcgatttgcaggtaaattagatccagtgaagttatgatgccagtgggtgctgactctgaaagttaaggagtagggccaaagctgttatctttgtgactccaaagctcattttctacctacaagctgcctcccaccaatgctttagttaacccaagtcctagattagtgattcttaatatggagtgacctttctcttaggggaatttggcaatttctggaaacatttgtttcattgttacatcttgggtggtggtgggggcggggattggggagtgttgttcactgctgacatctagtgggtggaggccaaggacgcttcaaaacaccctgcaatgcacaagacattccttgaccacaaatcgttatctggcccaaaatgtcaatagtgctgggtttgagaaattctgtcctcattgacgctattcgagatgccacatattcacggaataccttaacaactctcatgccccactggttgctaccactaataatgtatgaacagctgcagtcatcaatggcagtcaaagaatttgaagactttcatgtaaatgtttcatctttggagcattgtattgtgattatttactccagaagggaaaagcataaactttgatttgataccacacagctgtgttgggagtccccaagaccactctcaggctccatgattgattagaaggactcagagttcaaaaaggctgttacactcacagttagtttattataacaaaaggatacagatgaaaaattagcaaagaggaaaagtacatgcagtgaagtttagaagaaacctagcaaaagcttccaggtgtcctctcaccgtgcagtcacacagatgtgcttaatttttccagaaatggcatgtgacagcacaggcatagtgttatcagtgaagctcacctgagccttagtgtccagcgtttttgttagtggttactcacataggcaagctgcacctgcatgactgaccaactctcaaacctcagcccatgctatggaggtgtgaggaacaggaattcaccataaatagttaccataaacaattggatcaaacctatatggtgtggtccaaggcctcaggcatacaaaaacaattttgtttttgtttttgggatggagtctctcactctgtcacctaggctggagtgcaggggcgttatcttgtttcactgcaacctctgcctcccaggtagctgggattactggtgcccgccaccacacccagctaacttttgtatttttagtagagatgggctttcatcacgttagccaggctggtcttgaactcctgacctcaagcaaccctcccacctcggtattccaaagtgctgggattacaagtatgagccaccatggctggcgcaaaaatagttttatcaggcagataatattctaaggcctgatattttatctcccaggagctggccaaagtccaatcctaaggacaagctgttgtggaaaatgtgcaaggtttgagatagcccaggcctgctagaatccacccttccctgcacaaccattaaaaaaaaaaaaaagtaaacttgcaatttatagtgacatctgtaatgatggtagtagtgaggatgatgatggcataagaaacatgataccactgggtagcttgactgtaagaaaaccaagccaaatttagttatgaaagagaaaagaatgtacagcttgttagcttaaagcaggggtcttcaaacaacttatcactgtaggcacagatagtgtttttgactttgtaatccctatgatccctgtttcaactactgagttctgccattgccgtgtaaaagtagccatagacaatgtgtaaataaatgggcatgattgttttccagtaaaactaaggacgtggaaatttagattttatacaattttcatgtgtcacaaaatagttgttttttttcaaacatccaaaaacgtgaaagccattcttagtttatggcccgtacaaaaacattgtccctactttgctgagcttggcttgaagagctcagcggtaataaagccaccagtttaagcccttgagagtttttcttttggttttttaaattgcacagctttagcggttatatactacatgaacccatgaccttagctggatggcactcagttgtttgatgttcatcagggaagggccaaagagacagaccgtgtattaacacttaatccttgtttccatgaattcaccttttattgcagaattatagtatcgggcgctagacactgtgctaggtgccgaggtaccaaaacagacccaggctttccctctagaagtcaacagggtagtagaaggatgcaaaacaaactgtcaatgcgggtatagtacacagtgatacctgctagagccaaaagaataacaaggctctctgcatgaggagtcaagggggtggtgtaaattgagtcttaaagggtaagagttcacctggtaagaaagtgggtaaagatcattgcaggagggaatatggaggtggttggtagggtcccaagctgtttctcaacctttatctttagaatccattgagaaaacttaaaaaaaaaatacacatgcttgatcttcacctgatacctactgatgggaatttctgagccaagttgacgttttttccaaaggctaaggtatattgatctgttgagattagagagtaccttctagagaaaggttgcataagaccttaaaattttacataatgaaatctgaattttggaatttatcctttcagtggtaggcagccattgaaagctctattaaaaataacaattataattaaaaataaataaggaagacacctgttggtgagttagtacttgtatctatattcacactgagtaacagtcttataattaagacttgtattattactaatatgtgcgtgaagccctgtggtgctgggagacttaggagcagattatcaactgttcagcaaccctgcagattgggttcttaattactaatctagtgcctaggacaaaggctattgtgaaacttatttcgtggttttctctaaatcttttaagaaagtaaattaccagcgatttcaaacgcaaggtgacatgtttttttttaatgttttaacttgttatcattagattataaactctttagtttgaaagactttttgcttcccactttcattgttcttttcaaaatttattgttcttatttccccaacaaattaagttggtgtataaatagaaataaattcacccaatagtgtttaataccctttctgttaattacatgtagatactcattctctacatataaaacagagctgtcctgttgtcttttgaaaatgtagttttgaagaaccaactgacaaatggcaaaaccctactttgagtaacttcatcagtgacagttaatgcatttctagaacttccatggaattgttataacacattacagtcgacatattggtttatgaaaaattaataaagccagtggaaaatggaattccgcatctgcattagctatttacaccaaaagaatcagccagaattaattatgccgtatgctacgttctaatgagtttttcattaaactgtataccattatggaaactaaacaaggattattcaaagaataatgccaacggctgttattttgttgagagattaaattagttaatgggttatacatttaaatctgatgcaaaggttaatcgatgcacacttattgtattaaacccagtatcattttaaaacacaaacaccccaatatcactgatatttcctctggagaaaaaaaaaactatttgtatgattctagtgtttggttgatgtgcatgtgatattgtaaagattgaaatccaccctattctctttcatttttgaaaatgattttcactagctgaaatattatgtttgtttttagccatagcaggggaaggggcagtgtgtgcgagtatgtgtgtgtatgttgtggcaggcatagacaacttcatccaatcactctttgagagattgaaaggtgacgtgtattttctactctcaccaaaaaagtcaggttaaaattttaagcctaatctgagaaggcttagaaggcaattcaagatgaaggatctcatcctcattccacaaatagagtccctcctaaatagttctgtaatagtacttgaaatatgaaagaagtgacaatagagaagcctgtctagacagctttttaggctcttacagcatcttagaggctcttattcccaagaagataagaagagagtatagaaggccttctaggttctttgcacagacttgtaaattccactgttttcagttgaatgacagtttctaattttttttttcctaatcagagattgcaaactaaaatgtttttaggaacaagctatgacataaataagtgaaatgtgccaaattggaggagctgtgtctcaattatagcaagtagtggcttctcacctttgcctacagtggctctgccggacaggaatcctagcccagacacctatggtctgtcccctgacttcccactagaagctagacatatcttatcacattaaaactcctaagtttaagtgcttgcaattcatttaatactaaaatatttgccattaactattatgtttagcattatgtttagtggccaaacacaatagttcaatagctataaatttgctatttcctttctgaaaaccaaagtaagtcctcagagcatcattgttttagatacccaataataattgctatttccatgattatgattgattcacttactgattactatttgccaaacactttcatgccatagttgtaatcctcacagcaatattcgatcaagtacacatttttatctctatttgacagatgtaaccactgaggctcagagaagtacagagttttacccaaagtcaactcaacttccagtcagcaagatcaggaaacaaaacaaagttaaaagtttcaaagcctacactttttcagtgacactatagaaatctcagacgttcattatttctcctctgcatttgcctcctctatgtcttatttcaatcttgcaagtaggatttttcttatctgtagaagatacattctgcccaaaggcttccttggttggatttaaaaccctatcacagattcttaaacatgatcaggaggttctagctaacatctttagccaggaagagtcaggtgtttcctgccagatggcagcttcggaattcttagatgtggctttgttgtaatgggggtaatggatattgatcattctcatgctgaaggatatgtttttatcaactcaggaccaagtatcaccattgataaacaggtgtagctttgagagagagtgtctgagctttggagtcacacaaaactgacttatagttcagttttattatactttttctctgagctttcatttcctcttgggtttgataagaaaaagacgtgcatgtggagtacatcttgtatagcacctgaaacctagggccaccttaatgggcactgtcaatattagctgtacatgaggttcctatgtaatccctagcaatttactgttgtcagcaccatctgcatcccctggaagcctatgagaaatgcagagtctcaggccccaccccagaccccctagataagaatctgcatttagaagagtcccaggggattcagagcatagtagagtttgagaagcaaggccctagtagtcttatcatctatatattgacacctataactttgaaggacaaacatcttgcaagatagaacttattttcattgtttttgttgtggctgaattgatagacctccacaaatactctatggaataactttttgaatttttttttttcttttttgagatggagtctccatcacccaggctggagtgcagtggtgcaagctcagttcattgcaacctctgcctcgcgggttcaagcaattcttgtgcctcagccgcccaagtagctggggttacaggcatatgccaccacgcctggctaattattgtatttttttgttagagacgggttttgccatgttctccaggctggtcttgaactcctggcctcaagtgatcctcctgccttggctttccaaagtgctgggattacaggcagggtcaccacacctggcctaattgttttattgttttgaaaaacaatccaaaagaaattttgagcaaatatttttaaaagcctgtgtttgaaaaaagtttgttttgaacaaaaatgaaataaaattaattttttggcaagtattgatcaaatgatagcctctgaaatacttagtgccagctcccttgggaagggctaatggtgtactgagagacagttactgttagtatttttgcaagcagtaaagggatcttagaacactgatcagcaaactttgtctgtaaagggccagacagtaaacactttagcctctgcaggccataaggtctctgtgcaattactcagccctgtcattttagcagaaaagcagccatacacaaaaatgaatagatgtagctgtcttccaatgaaactttacttattagatactgaaacttgagtttcatgcaattttcactagtcaaatgttactgtgatttttgtcaaccatttaaaatcgtaaaaagcattcctagctcacagaccatacaaaaataggtgggggctcgggggaggggagcagttggatttggccaaaagtctgtagttggtcagcacttgatttagaagatgattgttagaaccatgggtccaggaatctggttggtatgacttgcagtttcagcatcacgagatctgtgtcacctcaggcaaggaaaaagagttctctatgcttcaatatcctcatctattaaatgggtataaaaatagtgtctgtcctacagggtcattaagagtaaatgatgatctaagttaaagttgagcaggatacccagtgattctcaggtattcagtaaaacactttgggaactcttattgttaggtttatcatattaagttaaatatttcctgtcaatgccactattagcctacattttggctgcaggagattaagtgaacagttggagtgagtcattaaaattttcaaacaataaatagtcaaggaacaaattcttctttgtattattcttgtgacttttccaaaaagtctcaagttatgtcaaaataaaaagcaaaaagaaaacaaacaagaagtggtgtattttttttttgaatattatgaaaaccaaagcttatgaaaataaattggagtgagggattatttacactatagacagatgcgcttcagggcccctttaaatatggaaatcccttggtacaattaaaacatgatttgatttataagaagtaaacatacagagcaacattttttctgcaacatctgtgcccaaatggaaatatccctatacttaaaactctaccataacccttcagagaagctcatctttcaggctggtgtaaaagcattagggattaactgtgaaaatattcttacatggattagctcaatgctagtcttgcgttcaaaaatgcatgactgtaaaagtatccaccgtccattcgggctttgggtaaattttggaaaaatctgtcaattgaaagcagtcacctccattgctaggtaccttatggcaacctctttggcttctaagtccaagagaagtttgaggcttatgggtcactttgtaggggactctcattataaggtaggaaggtgtagtagttggctagtgctgccatagcaaagtatcacagactggatggcttaacaagcagttcccaaccattttggcacccgggttgggttttgtggaaggcagtttttccacgggtcgggtagcagggatggtttcaggatgattccagtgcatttcttgtgtaccttatttctattattattacattgtaatatataatgaattaattatacaacttgccataatgtagaatcagtgggagccctgggcttcttttcttgtaactagacagtcctgtctgggagcgatgggaggcagtgacggatcaggcattagattctcataaggaacacacaaccaagatccctagctcagttcacaataagattcacacttttatgaaaatccaatgcttccacttatctgacaggaggtggagctcaggtggtaacatgaagtaacatgaacaatgaggagcggctgtcaatacacatgaagctttgctcgctcacctgcagctcacctcctgctgtgtggcccagtagggtccgtggcccaggggttggggaaccctggcttaaacaacagaaatttattttctcataattctggatgctggaagtctgagatcatggtgttggcagggttggtttcttctgaggcctctctccttggcttgcagatgaccatcttttctctgtcttcacctgggtttccctgtgtgtcctcatctcctcttcttgtaagatctgtcagattaaggcccacccatatgacctcattttaacttaattacagctttaaagatctctctgcaagtaaagtcacattctgaagtactcagagttatagcatttaaaaatgattctacaacagtggactgaaggaaggactcgatgaaatgagtgacagtgtaggaacccaaatagcttgtttttcatctaaaatttacctctggttggtaaggtttttggtaaaggacttagttgttctgtgccacctttgtaatgccagtaaaggaggactaatggcatcagacgcctactatggagggacaaatgcaaagtaaatattctttggcaaatattgaaaaaagctttttctttatgtagaatcaaaacatttctagcattgattcctattactactaaactttcagttatgatagaattatatagcagaaatagagaattttggccaaagccataatagttatatctaataaaaattgttctcgaataattatacttatcttagtgagcagtgtgactaattatgtaggctaaggtttggtttgatattcagaatcattcttttgttccttttcatgtatacatttgttactgaacctatgagcactaaacgtgataacatgtcatcctctggaaaagcacatggagttcaacagatgtaccccaaagcccagcacagtgcctggcacatagacgagtagatgccaataagtaccagccaaatgaatgataatactcactacatcatagttgcctagctgagcactagaggcagagggactaataagcacttgtgctactcagacattgccctgcagggttctagggttctcctcttagccttcttccctgagtaagctcctttcctcggctgagtgacattaggaaagccagacatcagtggagagttctatttttgtgtgactctgcaccaccacacagtagaggtttgttgaggtgatacggttctgatgactggagaaatgccaaggttgttggttttgcgccgattggattaacaatgtgaacacacgtggagtggttttaaggagcgaaaagtgtaataggcaagaaaggaggaagaaagaaaagaacagcttccccatacagagaccggagagtggggcctggaacagagaaaccttgtgtgtggcagataagtggtagattataggggaggcttgaggaggcggtgtctgatttgcatacagcccaggggattgctttggccaggtgtgtcatttatgcagcctgcaaaaaacctggctctcccaccttagtcctttaatgtgtaaatgcgggtcgccatgatgttctgaacacatggtgttatctggaggtggccattaaactgggcacaggtggtgacaaggagaagacagcaggaatcgccacattgagtgaaccctgttcctaatggcgggtatttgcatatcaaagcttgcccacccagcccttcgagcagtcttttctgttataaaagagatggtttgggggtggtttcttattacaggaaaatttccacctagaacctttacccttactatctgcctaaaataatttcttaataactcctgtattagaggtacagacagtgcatgacatatacagaaacttcctgcatgggggccccagaatactcattccatcttaggtatttcataaagtctagctgttgttctttgtgtcttcaagagcatcctccagatttcctaacccattttaatcttcgagctcttgaagctaattggccactcccagttgccaggcagttgagatgttccgttcacattttttgtttaaattcagaaattatgtaggaaaagttctagttattcaccatgtactgacttggaactgtgcccatttgatactaaaagggaacgggcagacattgccaaacagcctttcttttcttccttcccatcctccattttaattttatttcttggaagtgtagcatggctgcctatcagaaacctttggattctcacttcatttgctccctgcctcttagtctaggttcctggactcatgaggataggaagataaacacatgattcctgatctctttgaattagtagcatcaatgggggaagacactcattaaatagattacacaacacaattttaaaaagaagagaaaggaagctgaactctgccagacaaaggtacatagatagggtttctaggagaagccagagctgagtccagaaaggagttacctagagcaaggaaaagatttcctggaaaaagacaaagcctctgcaaaggcatggaggtgtgaaactgcactgctgttccggtttgagtccagttttcctcacttagggggttggcagcagagtaaacagttttcgacacttcctccttcctgtctgtgatgggaaacatcccttctaggcttgtgcctgccccttcaggggccaggaatgatcccctgcatgccgtatggagactactgctcagcagaaagggttccgatgccccatctgagaccttggcactggcttactcccttcctcactggaggattcaaaatcctgctggagagtggctgtgggacatcttgccaggttgtggggatgccgatgatcccggcactcagagtgggcgaacgtgacaggctttggaacgggctctgattattctgagattgaggtctgtcccatggagccaaatgtctgccaggtgctgatacagtcatcgacagtccaggctgcgcaggtttcttgttagagtgggtgagccaactttataagaaccaggaaagaagagaaaacacgtgaagtagattgaagctatttcaatctgtaaaagttatttacatgtagtgtgtaaatctatttgaacttcaggcatgcaaatttcctgccatgaacaggcggaagaaagattggttgaaaaaaaacactatttttagcaaagagggtagaagtggagacttgtttttaaaaatgtattataattcaatcatatgcattaatccttctgaggatcaggtattttcctaggtgttggggatgaaaagatgagtatgatttggctctaccgcaggtggattttgtagttcagacgaccaatgtctaagtagaaaattgtagtagaggaccacgaaggatctatcagggaggtttaaaaatgcaagataagagcatagtgtaggtaataactaattcacccctgaggacaagggagagaagaggtcacttttaaactatgttggaggaggacaggggaagcccctccgcctcctttttttttttttttcttttaagttgaaccacatgaacttggcaacattcaattctatttgacaaaaaaaaaaaaaaagtcaatttgaaatggtttaatctaactctaagagcaggaacagcatgaaggtttcatccacttcaccaactctaatcaaatgggaatcattgcctactggctgtgttgagaatgattgtgaggattccaggccaataggaaaggataatattgaaattgattaattccgttctggctaaagaatgggtaggtagtggtataaattgaccccatttgccatccctagattataaggaatttgataaaagcacagaagtctgagaagtacaggatgtcatcatgtgatacaaatgaaggttcctggcatttggcagtagaaggtttatgttgaaggctagggacagatagaagatccagctcagtggactcaatgaagagctatgttgaagctatattgagaagtgctttgaatgaccttgtaggccctctccatactgctgcttgtaccttattacctatttgacttactttttaaaacaaacacacttacctttccctgcccaaaaaaatgcatggaggttgcagtgttctctgctgctttggttttgtcgaattcaaagcgtccttttaagaaaaggtcacaaagcactaagggaacatacagtaagtactttccaaattaaattggaggatgcttttagataaaacaaaaaccaagtcctgtgaaggcatagattttgttttacaaaaggtcaaaatcattgcataaagattttttttttttttaactacgaagaaagtatccaaagaaaatatttcagtccaggttctcagaatccacagcattaaaaaaaattaggaatgcttcattatgccgtgccagaggttagctttccaggcaaaaatctgtgctgtgtcccagtggaattctataaattgcatcgaggatattgaaaattgacccaagggttttaaccatacaatactgaaatgtccttctgtgtatgtttgtgttacagttatacatttttcttttgaaatttagcaccccaagaaacttcatagctgattttaagtgtttttttaaaccaggcgtgcacaggagagaaggttgaggagcattccctaaatccacttgctaggatcctatcgtagatgattccgacctgataactctctgtatatcctatagaaacacattcatttatttctaagatttctagcagtgagcagaagcacatagataaccgctgcagagtcacacaggagtactcattgataaacaccactgactgtagaggggactaactgtctttcctggtaggtagcttgcctccccttgcttggtttcatatcccaatctccattctttggagtttggtttgtttgctgttaatccccagtgacctgctaaaactggaaatacctgaggcgaggttaaaccatggaaagtatcatctcatacgttgtgataaacttttttttttgagatggagttttgctcttgtcacccaggctggagtgtaatggcgtgatctcggcttactgcaacctccacctcctgggttcaagtgattctcctgcctcagtctcctgagtagctggaattacaggcgcctgccaccacacccagctaatttttgtgtttttagtagagacaggatttcaccatgttggccaggctggtctcgaactcctaacctcaggtgatctacctgccttggcctcccaaagtactggaatgacaggcatgagccactacacctggccgataaactgtttttaaatgaagaagaaagaactattagtttagcacaggtgaatcatactgacactccgccagactcttgatatatttactacccagagaaggttagttaatttcgagttaatttcactgttgtgtgaagggctattttgcgggtgggggtggctgttctccagctataagcatgggaaaccagatcgaaaaagaccatgggacattccttcaggtagaacctctggccctgggctgcttctccctgggaaaaagtggatggagttgtcagaccggtaacaggggaagagtgagatgggttagaaagaattgtgtctggtttactgtcccttgatgacatcaccgtgcagtccctctgtgtggcaggaccccacacgctttggaagttttaactacatttttgttgatcatagggaagatacagaaggagcatagaaccattccctagggcaagtctccaaggatatagaaaagttccctgttctgcgggtgcacttgtaaggttggcttcttatcatgggagattgctttcccgttgcggtcctgacaggggaatccaaatcaaactggggcggttgaccttccccagtcaaggaagtgaccagaaaccacagggaggtatttccatcaccagtaatggccttaaaactcctcagaattctaattattttcaaagtcttggagtttgagctttgcagcagtgggaaagtagcactgataccctgacaattcctgaccccagtcatccctggagtgggtggttgttcaaaatctgtcatagattgaggaggtatctcaggattccaccattatttgccgctgtaaaattccaccttgcaaggatgaacccagtgcccttcgctttaaatcaggaggaggcaagtcattgctgcaatgcagccgcagtttgcaggatgagctaggcagcctttctggctggaaggcagagagctttagggaagaaagcgggaatacagaagccgaagattctctcatccagtgtccagtgtgggtccagggtgggtcccagggatggcaaaaagttgcaatttttctttctccgccttacttctgttcttcctctgaagaactgattcggaaagactgacatttgaaggaagttaccgttttctctaaacctatcaacatgtatgcttactattgattgagtgattattacatgccagcccctgccctgggtacgtctccagtcatatgatgcacagccattctcggaggtaggtatatttacccctgttttccagatggaaacactgaggcacagagaggtacagtgacttgccaagatcacacagtgaagaggtgtctgagtcaggcttactatctagctccctccaatatttctcaagttcccttttcagtatgccacgctgcttccattcctgatctgaacctgggccctggggcaaccagagtccgctacacaaccccgtgtgaaaagtcatgacgtgtgcttggtgggccgggttgtggtgggtgggggggcttccattgattccctttggctaaggcagggggctttgttgggtacccttgtcctgcgctctgggatgtggctatgttttcatttctctgcatttctcggttgcattgccgtgatctctcaggtgtagtgtaccgattcccaaaccagataccatctctctctctctttcgtaggcacggtcctgttgtgccaggccaaccaggagggatcttccatgtacagtgcccccagttcacttgtatatacttctgcaagtaagcccactgtcgtggctctttttgttttgtgacataaatctgagtccaatcaccttccctgccatgtaagttctctccccctccctctgccccaccctctcttgtggctctctctgaggtgaagttaattttcataagcatgtctgtctcccatgccacttcccagatgtcctggacattctctgttagatccgtcaggattgggtccaatggttgggaatgtgggcatggggttggtggggaggggcatgggagggtgggaagctttagctcattgcctgccttctatcatagctttgcaaattaatataaaaataatttaaatagcatatacaggccaccccaaaggcacccttgcctagtaaaagatgcttaaccaggattcttgtacacagttgtctcacgatggaaaataccactagcctgcagctagtcacttgtttgcaaggctgttctgtcctttgctatgtaattccaatgaggaggaggaggaggaggaggagcagagagagaaatgtggttcccccctcatttaatcaagtgcaggggcagcaacattaaataactgtcttttaaaaaatcggggcacttttaaacgtagataagtatacccatccagtgcgggagggaagagacccaaaataaatacaggaagtagatcacaacattgacatggaagaaccgaagatttctctgcctcggatggatgctctgggttcaaggatgccctatcctcaccccaattcccagagcaggtagaagaattaaagccgccactgactctaccatgttctcccagagggtataccccttcttaaagaatctcccagccacagctgaaactttaacatctgttttatacaatgtgtgtaaatcctgtggagttgccgtaactgcagaatgagtcgtctttagggtcagtgcttaaaagtgagtctgggtgcctggagtgggggtggggctgtttctcagagtagttgtaaaaggcagggatggggaggagagcaggagtaccaggctcaagggataagagacgtaggagaatcctcaccatcgtgccaaaaccaaacatcttcgtttcctaaattgtgaagctgaggaaaaccaacctcctcactgttggggcagcacctccctgttaccagcagtcacagggaatcaaaaatataatgtgacacacccaagggtctgaagtcttcaggaggtctgacagccagttgtttctcacagttagaggttttgagacaaagtctcactctgttacccaggctggagtgcagtggtgccatctcagctcactgcaacctccgcctcctgggctcaagcaattctcatgactcagcctcccaagtagccgggattataggtatgtaccaccactcccactgatttttgtatttttagcagagatgaggtttccccatcttggccaggctggtctcaaagtcctgacctcagatgatccatccacctcagcctcccaaagtactggaattacaggcgtgagccactgcccctggcccagactataatctttaatggcaattttggcattaattaaatgcaagacatttttctgtgcctcccaagaagcccaaatctaatcatattggcaagaagtggttctttctgaatttgtgacaacaaattcagaagggcctccttggggccagtgtaaatgtgtgtgcatgtatctcctgaaattgtaatgttactacacattttcacatgtccagccttgtgtattcctctcaaaaccagcaccaggtaggtatcacaatgtttgctttacaactgaggaaatggagggcaatcccagagccagtgtgtaatagatttgtcttctgaacctgggaacattattcaaccttcagctacctttctgagtccatttgactaaatctgatcgctgtaccatttacctagccttcctcgtctatattattttctgaaagagagttggtgtgccaaaacttaccatagggctgggtcctagagtattatttttttctctaacattgcggtcctatagaagtgtctgggataaaatctttatgctatccagcatagtgctgatggaactgagacactcatttttatgttatattaattagccatataggggctaatggttaccatattggacagtatggctctatatgatgatatgacatatctatatttcaattttctttacagaagtgaacaaaacaatcaactccaaaagtgtgctagtttgaattggtatagctattctaaagtgaattggggaagcatctctcacatcacatgaaaatatttcccaaattctccataataaaatagctgaagcatagagagaaaatgaaaccatctaaagcgagggccacccaagccagcccatggcctgtgttacaaggcttatgaatgaagaatgatgtttagattttccaaggattgaaaaaaacaaaacaaaaacaaagaatgtgccagagaccaaggtggcctgcaaagcctaacgttttaacagtccggctctttacagaagaagtgtactgatctccaatttaaagggtcgattttagtattaaaaatacaaagtggcaatatcactgcactgtgtgtagctgtacctttttctatgtttaaagtaaaaattaacaattatgaaattgtataatgtgcatccaacatccttcatttctaaattgtatcagtcgtattacctgcacattatatgccatgtgctttttataaaaatatgttaatgaacccatagtattgtttcattatattatattttaatctattcccccattcttgagaacttaggttcatagcaattttttttcaaaaatattaaacaaaataaacacccttcaatagagcagttttaaagaaaatagctaattttaccaccccattaaaaagcaaaatgaaaactagtttcttacattaagaatcttcacttgtcgaggcttaagcaagggcattcagatggtcaatctcgattagtattttgtaatggtgaccaactctgagacccctccctctccaattgggtaggcagaggggccttcagttatttctgtttgcaggctgtgcattggtgttgaatgttaagtttatccgcaaatccctaagacacattgctgcggtttcctttctcttttatggctttttggtctaggctgtttgtggattgctggcttggcaacattcacttaggtttttctcttccagattaggtgcatattctactacaaaaccattccccatttcctgcaacaggtcagctggcacataaagggttatttttacatgcaggcctgtgcgcacacacacacacgagttatattcatggtcatccaggatttttcttctcccaacagtttcgatttgcacagggctgagagtcacatattttatctttgctctctgatgggtgcagactttttctctaggaatccaaccattgccctcaaagctgaggctaccatacttttcagcaattgtgtaggatgctcttgttttttaacttgaaaatgcatatgttcctcatttctgtttaacagctgtgctcctgaaggaaggtgtgtgtaaattacacttttgtatgttggatcctatgtgtctacagacttgcaagataactctggagcttcgtttttgtttttttgcgtttttttcctccatggatctttaactggcctttgatgtttgtttttttttttcgagacttaaattgtacctcttcctagtcaaatagctaatcatctgtaaataacatccttaaatgcagtaggggagatggtttttaaaggaaccctgctgaattagtctgtaatgaaaataattcctactgaagttatctgcttttgatatgcatttttgcataacagtgaggttttctcccccattaagtgaatcatcctaacaatgtgacccaggactcataaaagtattaagagaaagattttcactgataactttgtgtccatacaactaattccgtagactcttccatcggaccccaaatgactccagtttttctccgtcacccctgaacttcatgcaggtttaaaaccctagttcaaattgtgtcacaggtcatcatgcatcctcttacacgtcctaataaactactctcatccagagtgtaaaatgggcctgctttctatgaaacttaaatgaagaaagaacaaaactctagagaattaggcaacatcacctagtgtcaaatggaaaacatttgcaattaatatttttcaataggctttcaatagaaacaattcaaccccttaacagaaaggtttagtgaaatgggcagggctgcttggtatgtggactgttcattccattccgaaggccagtggtcagcctgctcctcttgttgaggggaaaggtactaggtgtattattgccagcgctgttttgcatatggcgaatgctcaacatcaaaattggcaccaggcagaaataggaaggtaaagaacataccacatctcttccaaattaatacatgagtttcattttcattagttgaagtatctaaaggtaaatcattggttccatgaatgaaaaagttcacttctgattcagattagcaaagccagctaccgcagatccttatttacatatgaagtagatgtttccagaagcacgtaaatgtttattttgttttcttcaggattttatgaatatgttttaaattacaatagtaacaggtgctcattgcaatcaatgtgaagtgtgcaaataaacatacacaccattgtaataatgtgggaataatatccccactttatccagtaacataaacccttaaaagtgtgtggacgcccagtatctttctacattttctccgtggttattcaggaaaggacatacacacatgcaatggtgggggcgggggacggtgtgttattagtttgactttacagaggagagtatacacagatgttacatggacattacatatatcaatcatatttagtttcacataatacattgtgaccgtctccctttaagccttttagatattttcatccagtttgtttaatgacataaatggttgacagtcaattcaaccattctctatccatagtcattcaagccacttctttttactttttattttatttatttatttttttattttttgagatggagtcttgctctgtcacccaggctgcagtgcagtagcgcagtcccggctcactgcaaactccacctcctgggttcacaccattctcctgtctcagcctcccaagtagctgggactacaggcgcccgccaccatgcccggctaatttctttgtatttttagtagagacggagtttcacgtgttagccaggatgatctcaatctcctgacctcgtgatccacccgccttggccgcccacagtggtgggattgcaggcatgagccactgcgcccagcccaagctacctctttttctattccctccacaaggagatagtaaaaatatttgcaaatacccttacgtgcaactacatccattctacacttaacattgccaaacatggaactgttggttcccttccagcatgcttgccagcactgccatgttttgctctattttgcaaattgcatagtgaaaaataacatctcaatttgttttagtttgtctctgcctttctcctattaatgatcaccgtctttcacatttttcatttagactttacctctttgaatttccagtatacatcttcctgtttgagatttttcttattttattatcagttcacacgtgagtgacacttgtttactaggataacctatgaatggttcagatgttacacgtgtatttcctgttttgacgattgatgttgctcagattccaccatacatttttaattacataggcaaatgtatctgtcttttctgatcattttagacgtcattttggattacaaaatccctgtcaagagcaagttttgttttgcactgtatcagtcagtttgggctgctataacaaaataccgtagactgggaggcttaagccacagacattcattttctcaaagttctggaggctggaagtccaagatcagggtgccaagaaagttaggttccggtgagggctttcttcttggcttacagatggccaccttctcccatgttttcacaagagagagacagagacagagagaaacagagagagagagaggaatagagcaatctctggtgtctcttcatataagggcatgaatcttatgaagggcccaccctcaggacctcatctaaacctaattacctctcaaaaggccccatttccacaaagcatcacattgggggttacggcttccacatatgaatttgagtggagaggacataatttagtccgtagcaagccccttgatacagggatgtcagttttatttgtcaagggctagaaaagcattttctggaagaaatttctttattgttccgtatgcttatcaatgccaatgagcgcgttttccacagttccatgaaagccagagttgaacagtagatccccatcaggataaatcctaaagttaatagaagattaattatcgtttcccctgaaattttcaccctgatacccttccctcctcaaaaaaaaaaaaagaaggaaaaaaaagatatcatgggcaaatgcttgggaacctgaatgttatcaaaatgcaaaatcaattcctcatttattgacttctatgaaactcaagggcaggtggtaggggcatagtttcaactgatatattgattgcagattttaaggaagtaattgtgtggaattcataaaacgatgatttaagtggcagaaacatacataaatcaggcctgtactattttacttttaggtaattgatagaacttccatgggtttctgtaattaaagtaaggacctaaattaatttacggcttcctttttcttctgcacaatacagaaaatgtcagtgggctggactcagttactagaaaggacacatacaggtcattttgttactgacacattggtgtaaagaattgtgtcttctttttccctcacttgccagtgtctgacagcttcttgctttcctcctagatatttttctactattttatggagggggtgcttaacaataactagctccgggactagggtaagcaagtgacgtgctcacttcaaagattaaaggggtatccaaatacctcataaatagcattttaatgcaatatttttaaaaatctaaagtaacagaaaaagatccatgattaacagaatatcaagacagaataagttttattcctttttccttttggagccttaagatcccatatggcttaatccagcactatttcaattttgatagtctgctcatcgtggatttaaaaaataatttgggtgttaaaagattgcattaaaacatgatctatctccattacagagttttttggtgtttcctcccttccaccccccacttaagttctgcaacgacagtgaacgcctgttaacctagttgcagccctgaaatcatgatgatatccataatcataagtagtggttattgggcactcactatatgtcaggcattgtgctaagcccttctcattagctttcttaagaaggaactataggacaggtatgattaattatgctaccttttctcaggaggaaatttaggcttgggggcgttaagaagcttgtccgagatcacccagctagatcagctttgaaccaagcctgtttaaatcccaagccgccttcttcactactctctcaacttaccccagaggctggaaacaggatggactccaagaaatggctgagcagggagtggtcacggggaacctctcagcagctgtccagcaactctatttgggccaaggctgtgctgtctcctccccatcccatcatgtttggagaggcagttttcccctctttgagatgtctggccagggcttagcaaaattattctgtaaaaggctggatgttattaatattttcagctttacaggccatctagcctctgttgcagcgactcaactcttgttatagcttgaaagtagccatagactactgtacatatagccatagacttctaggttgaaacatgaatgaataggcgtgactgtgttccaataaaactttatttacaaaaatggtctgtaggccagattgggcccaagcgccatagtttacccatctctttgtcaggccgtaattcttacttaaaaggacagaacatggtggctggctgcttgggggtggaaataaggaaaattcttttaagtgtgcaccctcatgtattttttgcattttgtaccattttatcacattttaaatgacgtgaagtagtacataaagataggtacccttctcctggtacctattaagatcaagatacaaattgatcttgatttaaatgatacaaaatgatcttgacttaaatttgatcaagatacaggaattgggtggttagttttgcttgcacaatgatcaaatctggtttcagaggcttaattctactgacattagtctaagacctgccccagtttccttgggcaaaatgtgaagactccattgtcttacccaggatcttctgtctgaactgtttccatttctatccccacactttcaacaatgctggctctaaaagatcctctgggctggacccttcccatcagggaatcagacactccttcttctcttttgctatggttcagcattacggtggcagcctacctgtgtcctctttgtcattttctcagagataattccttctagtttttagtcctttgatcggagagggggttgaaaggtgttacttcattcaaccaatctttattgaagttttttctatatgccaggtgcaattctacatcctgaaaatatgctgtgaagatactctcaagttggcttctattatacctatattcttggggggacacataacagacaaatatatataatgctaaggtttcagaatttcaaacgcagtgctcctaggggatatttgggaagtaacacccaacaggagacttattcactgttagcactgccattggggtgcctctcagtaggtgaattaagtgtccctattttcaccattcttcaacactgtagacaggtgccctttgctactgagaccctatttgcttcaccaaacccatggattgaggtgttttcagacacctactaggtgccatgctctccctgccacctcaatcatagcacttatctatttatgaacaatagttgcccacagcattgcagaattatccagctaccccccacccaccaatggtgaactccagagattattctttctccatcactgaagcaccatctctgcttttctccatctgctcaacttttcccatgtcccagcacatttgattaacagatgatttctaagaggcttttactagctctgatattaacttagttattccacctggatcacagtcctcagaataggttcatttgtatttttaatccctgcaaccactacccccaacttcttcatccgtgtgttgtttctttggctgtcataatcataacccactttgttgtttgtcctttttaaccaattccaagaaagaattaaaaccactagtagaacctctcacccccagttgtttaaagggaaagttctgcaaagaggcagccacatttcaggcagctgccatgcagctctctgtcattgctttcgttattaatctcaatgcagaatggtgattttcattttttcagatgggtgtctggctgcaaaaggccgccagttgcaaaaactaccatcccatggtgtgcccccaaacatcttatttgtcttgatatttctttcacagaaatacatatgacagataaggagtcactagaggatgcttttgctttgtgtcagacagatattaaaacaataaactatgttgccctgggattccaatgcatacacagccagagaacaaggccgagatgagatgtttcagaaaggcagtgaggcaattattctgggggaattccctggaaaccccaagtcctgtgatagcattgacagaaagtgttttttaatgctcacattttcttaagaggatcaactggctagtgcagctcctgcatttaactccttgacaaaactcaccctcatccggcctcatcagagtcaagagaaatccttcaatagtttgagaggcttattttgagagtttattttttaagcacttatctgccctttatttgcttccccaaactaatgtggatttacattaaaaaaaaaaaaaggaatccattttacattcagagctctgagcaggtaagttgcaggggccaacggcaagatcttgcttggttcttggaatgtaaaagaggacagtttgatgcaatggagcaggtgcacattcccaagggccccagctttataagttgagtcaagctctctctgggtctacagagctgggaaggaacagcttaggaagggagaggctgaatccaagggcactcataattcaagagctggagcaatcattctttcatcaaataccagtcttcttggatagaaatgtgtccaaccatagaggtggctgctgcttcttcccttgccttatttcttttctaaaataaatctcagtgcaaagaccatgaggagcagctcaggttgcctctcatccaagggaaaaagagcctggtgtagttcatataaacccagtaatgtaaacacgtgcttcaaacaccattttcttaaatcatgtttttatataaaagaactgtcatgccaaaagctatttatccctaatggagaacttcggagcactgttaagaaaatgcagtttcagaaccaaacaccacaccacatgttttagatttatctccttgagttttgtttgtatgcaacataggctcttgatgcctaatacttttcatatgaaagcaaacagaaaggcacaaccatctatgggtatttattatccctacccttactatttgctacaggagtctcaaacatttccagaagatcatttttcctttctctggcaagtcctaattcccactagtggttttacagcatttttcttgagctacagcgtgacttagtgaaaagagctggattcaggaaagtctgggagtaaactgtcacggtagactagtgctgtgaccttggccaagtctcctcgccatgtaaatagccatgactacctacctacccatgagcactaaatgagattgttgtgcagcgtcctccaggctgcttgaggcgttacagctcctcaaatgctactctttctttttctggctcagaagccaccttctccaggattttttaaagtccaccaaaccagatgtgatggtgtacttttatagtcctagctactggaagggctgaggtgggaggatgacttgagcccaggagtttgagattgcagtgatccatgaccacgccactgcactctagcctgggggagaccctgtctcaaaaaataaagttcaccaaagaagcgggtttggatggtttatattagtccagtgactggactggtggaccactcctggatggtagttccttagtctattctatatgggtgttttggaggctctggctcagatatcaggcagatgatccctaggctcagacagtacctgtcctccaggttggctttgggcattgatcaaaggatcaggactcttttttttaagtctgaaagctgatgctcaaaatcagatggcctcagcactgacacacagatcagctatccccacagctatggctgggactgaaatgaacaatgcatgtgcgtcgcgtacccatcttgtgagccaccgtcagacccctctgaaggcttcatgttcaggagctgcgtcagcccaagagaaccttgggaaatccagcccagcataaggaagctaatttatctcacttgccctgtttcctacctggagaggcaattcaccgagcttgctgtttcagccagctgttagatagaacatgaatgatttaacaattgaaacttcagtatgtatatgcactggataaagtaattatataaattatttgggttttttttttccgtggtttcccgggaaacaacaacatggttatcagtacagattttgttaaactaatagatgatgacgaactgctgcatccaaattaaaataaatctcagctcttcagggctttgtcttctccttcaaaggacagaaagcacctttgcaaatgccttttgcagttctgccaagttaaacactccaagactgagactcattctcattttgccgaatgttacaaaaatcctgcccggcgggggaaattgtcgatacctgtgagtaggcaaatcacaaatacctcttctgcatagtaaaaacatatcactacacatttagcagccatgacatttgccacttgtctgttggattaatctagccatttataacctgtgaggaaagatacaacagctaactttgggaggtaagcaggaacagcacgccaattagttaccaccaattctactgccttcgctcagagacacaaggaccttacatgatcaaagaatattcatgtgtgtgaatggtgtgtgtgtcttttgctgttgctttaatttgttaagttaggggaactttctcctttgggaacaccagactcgttgctcagagtaaatcccagtgtgctcattacatgtaattttattttcctagatgactatttttatttccacaaaaagaagacttatttcaaaaacccaagttgtaatgtgatatttgataacatattaaaaaagcaattatatatagaaaaacgtgcaatagcccaaaatgttatgaaggtttcttatgcagatcttccaaggctttgaaataagtttctcattccagtcttccaaattagaaatttctagctgaatttagttgtaaggagctcatcattgtgacagtaatcaggtttgtgttcatctgcagcctttactcacactgtactagtacaaacctgctcactaactctacagaatctgcattcccaatatttttgggttgaacacaacctccccctcacatcgagatgtagaggtaaaccctagtggcaaagggaaacagcctgcctttgaactcttaccaggaacataaatcagtggtgatccctatggccggcatccaattagcagaaaaggaacagggcctttccaggtgtcttgaaatctcagaacttaagtatctaacagaagaaatggcgggcacacacacagaccctctaatgtctcccctatcccccaacaagaagcatattgagatctctgggaggactgtcaacagattcccctgcaaattaacccagtctatgatgaattggggctggctctgtctcagatgtggtatggatatagggagatgatgtagcagcttgtacaggcaataggagggaatccaaactgagagtctctaagaagcagagagagagtagaagtagaaagcttttcccggagcctgactggggttgcctttatgttgcatgatggataaaatcataggctttggtgtcaggctgccttggttcaaaccgctgggtgagtatctgagccactctatacctccatctccaccccaggaaagtgaagatagcaacaatcatggttcatatggttttgtgaggcgttagtgggttaatctccgggtctggcaattagcaagtgctagtaaatcctagctgttatcatcatgcaattgaattttctccacctgataatggagcctcagaggttggaattttgccaactgcaatcacatcgttccttgaattactccagttatcactgcctgggtttttagacaagggaggtccaggatcccttatcactaactccatcaccccagagtttctgtgggaatatgcatccctcacaggccgctccttagcaactctcacccgtttgaggattgccacccattttctttcgtaactgtaggactatggcattccgagttcatcacacaccgtagtcaatacacatatcagtgatcaccttgtgctcggtcatcttctagatgttggagacacagtagggaccaacatagagtcctcaggacatccctatagagagatgtataaggaagttgaaatcaactcaggtgataagaaactaatgggaaggaaaaagaaaacaacagggtaatatgatggtaactggtaacagttgtgggtgtcaggagatgtgaaattagataaagaggtaaagcctttggagggagcgatgtttgaactgagaactgaatttgggagtcaagttcactgttagagcctggacaaaggagagagaatctgccaaaagccactgaaatacagccaagtgaggctggagaaaaaagagacattttagcctcttacaatcttattcccgaagtctagctgaagtcgagatttagatcaatatattcagcttggacaatcaggccagcacgttgtcaccatcttttttttccctttcaaaaatgtgcatttctctccaagttcacattcttgccaattccttcgatgcatcccaatcagacctataacagcctagaaacttctggctaatttggatttgactaaaacttttctaccatgacgttatgtaaagagattcaattatggtgcgcagtgttttgtgagtaactaccacccataaaaagttaattaatcagggctgtgtcaatttcctcgtgccatgtcaatttgctgcaaggtaattaatcactaatcacccaccaagcagcaggctgagggacaatccctgagtcatttattgtctttccccaaataaatggcacacgcagccaggaagaaacacatcttgcctttcataatatttttatcgacacttttgcatgttgtaatagactgcagcaacaagcagctgcagttcaatggaatatgaatattaaagaaacaaatgagcagagatttataggacattgcgtttctgtaatgtcagtgttgagattaaaccaagcaaatgaacagtgaaaaattactcttccatgtggagcatggtgattagacttgtacattaattagaaatttttgttttcctattcaatgcatttcaaatgagaatgtcctagaagaaactgtttgtccaaaatgtagatttattcacttctaaacagcagtatttaatatcaacatgcatttcatactgaaacaagggtcaatcccaaatgtgtgtttcagggataaatgtatgtgtatatgagaactggagattcgacaaattaagtggccgttttggtctttctatcagtgaccgaaaggatggaagctttctcccccacccaccacccacccaccttttttttttttctgcgaaactctgaaattactggatttttttaaaaaaagaaaaacctttccatttttgtttggagctagaacttaataagtgccatcatgttaaaattttaatttaaggccatttaaagagagtgacctagttgtctgtaaaatcctatgttataaaccaatttgatgtacttttgagattcgttctgaaaaaggagaaaacatattttgccatttggaaaaaatcaggttttttgattcttcattgtgatgttcattgcacgatgccctgcctcggaaattgctgctctatgagctatggctggtggtttatttcgcctcagtatgttacctattatgccacttcttaatttatggtccagcacatggaatgggagttcccccaaggggaatcctgcaaaaccatcaacccgctgttgaaagcacatctgcacccccagaattgtgtaagtgaatatttcctaccataaattacccacagaacaatttcaccccaaatttgcatgaatctctctccatcttaaaaccttccaaggctggggaaatgtgtcattatggagcaaagggagaggaggagcaggacaaagagagcccccctcatccattcggatgcccaccttttccagggcatctggcagtctcatgcaaattcaaaccagtgcacaaatgcaaagaataattgcccattaaagcggttgtatatttttatggctttggtgcagaatccgcccccctgtcgggttttgcatctgctactcttccatctcccccagagctctaaaactttaatatgcagtttataaccctcaagtattttccactggttttgtgttttttctcttgggatttcctggctggtgagatgatctcatttgtgtttattttcgaaggtaagcaccatgttcgtaaaagagggagagaagacacactcatcactgtaaatacattgagtgcagggctcattggaggtgggaggtgggggctttgtttttgagggggagacaggcagttagcagttgacactttagtaaatggcccatttggctggtggatacacccacacatcttccgttctaaaatgttgatttgccgtgatacttgagcaccaccacagcgtgcctcttgttacatccctaaagcttccatttcatcgagttccatgggacagaacttcttattcccaagaactgagatggttactctactaacctcccccagaatatgctctgtatataaatctagctgaagggtgagagtgggtgggctggaaattctcatgtgtcaacaagatgctcaattggtattttctctgaaagctcttgcctgttttgagagaaattcatttttagcttatgagctgaatccaatttgtgttgtagtgataccagatttttctctttgattcatgctggataaggcttcagaaggaatctcttcagtataatgaacctatgggttttcttgtttccctcatgccaaaaactaaggatttatactatatccacaaatcaacctgcgtcctttccattgttccttattgatggtctgcttacatgtgagttaacttgaaattgaactaggaaaaaaaaaaaaaaagcaaacttgcagtgctggggtttagaaatgaccattgtttggtgtctttttcccctaacattgttttttaattaacaaagaggcatttacaaatactggatagggtgatgtttgacttttaacattgatttaaatattttatttcatattctagaaatggagagaacattgtgagtttccactgggcattttgcattggctttattaaatagtcattcattgcccacttactggatctagacttctaagccagggtatttggcatgtctggatccagacatctaaactaggatagatgacataactctcactcaacaaaatataagtgccatacctcaaagtaaacatgtaagaggttctctttctatgtggtcaaaaaacagttttagtcttgtttaatttgtgtctgaatcatctgtccaggtaatcatctcaaatatacattttaccatgttccagaatcctacagaccaccacacctgtaggcaaataataaaagcatccattcttccacactgtgctgggttttttaaaggaagtgtggcaaacagttgtgtgtgtgcatgtgtgtattttgcccttgaaatggattattcgtgttagtggcatgcgaagaagccatgttgtccctaaaccaacaattgaggaaaaaattatttatttatttattttttttgagactgagtcttggtctgtcacccaggctggagtgcattggcgcgatttctgctcactgcaacctcctctacctctcctgggttcaagcgattctcctgcctcagcctcccaagtagctgggactacagatgcataccaccacacccagctaatttttgtatttttagtagagacggggttacatcatgtttcccaggatgatcttgatctcttgaccttgtgatctgcccaccttggcctcccaaagtgttgggattacaggtgtgagacactgtgcctgaccaggaaaattcttctaataaagatgggaagaaacacagaaggcacagtcataagtcagaagagtttggaattatcaagattgttattttctattgttcctggttgcacataattattttattcagggactgttgttgctgggttgtcagagagcatggtctggggctatatggaagggtgagatgtgatgaagaccctttaataggtgttacctgtctggggccaaaactggagtcccgcttttcccctgaacaagaaacaattttaaatcctgatagtgtgctgccatcgaggagaatttaaatgaattgagggctctgacaattccaagtgcaacaaacttggtccaagcagcctccccttgcttgattgaaatcatactctttcaaaatctggttactttttccgagacagtgaaaaacgtacaagggtagaagtggaaattatctttctagggattgtgactaagtttcagttgtgttacaggaaaagggttcctatccagaccctaagagaggattcttggatcttgtgcaaaaaaagaattcggggccagtccacagtgcaaagcaaaaggaagcttataaagaaagtaaaatggggaaagtacagctactccatagacagtaggatgttcccaaaagtaagaggaggagcatgtccaccccttggtataatacttgtttatataggataaaaaaaaataagatcatggggaaatgtgctctgctacaagggtttgtgataaaggattaattttcttaattactatattttgcaagaatcaatattatctttaaagcaaatttaggaatgcttctgttcacaagatattgggatatcaggacactcctaaagtctgggtctgtttagtaaacataatcaatctgtttccttaaccacaaacatctagaggccaggaatacctaactttctggaaatgtagtccagcatgtcttggcctcatttttcctagccttcacttacgatggagtcgctgtggttcgaacacctctaatggttgtgttgcttgcatgctgtttatctgcaaattctgagcaggtcactttgtacacaggacagtgttatagaaggtggacagtgaagaggtggtggctgtactctcccagaaggaagacaaacattggttaaccactgacagggtgtccaggcacagtattaggtacctgatacctgcttggtaccagttactcatcctaactgatgagcagaacgtggagatcaccacccttacgcagcttgcatgcacgcaccagtaagcgtccttctccttcatttctgtgactcaagctaatgatttttacatgaaccaggggaggaacagggcagccctctttagaaaaaaaattccaaagtgactgaaaggaaggattgtaatgaaggcaggaattaataaagaaatgaagggagaggagaggaagaagagggagaggaagaagagcgaggggagaaaggaaaaggaggagggaagacaaaaggaagaaagagggagggaaggacaggagggagggaagacaaaaggaaggaagaaaaagggaggggagaaggaataaaaaaggagcaagtataagaaggaaggaaggaatgtaagaaagaaaggaatgtgatcgatgagcatttttctaactagagatttcacgaaagggccccttggccagccctagattaacaagaaagagaccactgaaaataccaaccacccaggacacttgaatcctccagccctttctccatgaagcctctggcccaaagcatgacctgtggaactctcttttttttttttttttggccaagggtacctagccttccaggaaggcactatttaagccaggaattgattttcagtccttcctgtgttcttttcacaaaataagaagtcccccaatgtgccctgcttgggagagcccaaagaacctcctaggaagccttgtaaatatcctgcctcaggaaatccattttctccctgtaatgaagagggtacaaaatggaatcctggctccacgctcttaacagcacgtgctcccctctctctctcttgccaagcttctgtttcatgttatatctcaacatctaaatcctccaagaattattgtaaaagctgcttgtggctgagagggagcttgtctggctcactcggctccatagccagtgacaatgaatgggtcagcataattaccgtgtttcctcacacaggcagccagctgctctgccagattgtgaatttttcattttctttatttcaaaatccagggtgttcctctgaaaacttaatagttgaactgtggcaagacagatttggagtcaaggccattcccactcattttctccccagtcctgaagcaagcgtctcatctctcattacttatgggcttttatgatattaggatttactcgtgttccccattaagaccccacacgtctctgcggtttcaagcataccagttgccacgtgatccaagaaactcaggtgctaggagctggcaaaaaaagttaaataaaatggcatgatctatctttagcaagaataaaaaaagttaaaaataacctttatggtcttctcagatacaaatagaaagacggaatcattctgggttctacaatcctcgtattttacccgcattgtgatagaaagatgcggtagaatccatagaacaggacggctgtgggacctttaagaacacacagaattccagataatagccatttggtcttcactttggtcgggttcgggggttttatttgggcccttaaaattgcaagagtaatttggaatggctgctgtggcaaaccccacccgctcccttcacccaccatgtaagtacaaacataccctatctatgggtgtaggtgtaattcttggagttctaagtgcactacatggtcaccccgtccaacctccttggtcgcagccagggcctccagtgaggcttctcatgcacattttttccttccaattcttttgccttttgctccttctgcaaccctcacctgggtccatgcatcagtgtatgtggaaaggactctgaataatggggagacataaggtggaacgcttctactcctgaagctgatagcgggaagggaagaagctcttcttggcagtttggatagagggtggagacaactttaacatgaaatgaactacaacccctgccccttgagaggtttgctcttctgcagaaagcctggaaaaggagttggttgtgctgggttaactaagagcatttccttcatggtgggccttttgagcctttgctgtggctctcctgggacagggacttaccaaatgcattttttcagaaaagcattctctgtggacacagtttgggaaacaatacctgctgcttagtgagatgggacaagcgtagtgagtatggtgagagcactgggagggttagagaagcgaactgagcttgaaggaaaagtggtttgctgactctgtgggccctgatgagttaggatttgcatgagaagggaggaagggcatcccaggtagaggaaacagtgttggttatcaggggacaggggtaaccggggtaaccatcaggcatcctctgcggacacagtttgggaaacattgcctgctacttagtgagatgggacaagtgtggtcattatgctcagagcactgggagagtcagagaagccaactgaacttaaaggcaaaagtggtttcctggccccatgggccctgatgagttagttaggatttgcatgaaatgggaggaagggaatcccagatagaggaaacagcagtagttatcagggggctggggtaatcatcaggcttaattccccttcctaactcctcctcacctcctcatcttgctcagagaattttacccaagggaagatatccccgcccacattcttcttcttatttgagaaaaagtcttgctgtgtcactcaggctggaatgcagtggtgccatctcgactcactgcaacctccacctcccaggttcaagcaattctcctgcctcagcctcccaagtagcgggaattataggcatgcgccaccacgcctgaccaatttttgtatttttagtagagatggggtttcaccgtattggccaggctggtctcgaactcctgacctcatgatccacctgcctcagcctcccaaagtgctgggattacaggcatgagccaccgcgcccagcccccacattctctttttaagggtcggggtcccagacttatcgcgtatttgtaatcatgctggttgcctttgcctttaaatgctgcacaggagttcagcagacttatcagatgttggtaataagctgtttctcatggcatgtgtggtttgtgcactcataccacatacatgtgtcagtgggaatacttcaattagaagttttaagaagtgatatctgtacatgaaggaaactggaaaaataggatgggggaaagttatgaataaaaaccactcatgcagttcggccccagagattgctagcatgtggaaagttgtgtgtatgtgtatacaaatatgttcatatcagcatatgtacatatatgtatatatacatgcacacattcatacacatgtacacatgcatatacacatatgtgtattttgcatgcaaatacacctgtacatatatacataggtatatgattgataagacatgacacatcttgcaatctgcccttttaaaaatatgtttgtgggttgggcgtggttggtccataactgtaatctcagcactttgggaggtggagacaggaggactgcttgaacccaggacttcaagaccagccggggcaacaaagggagatccccatctctacaaaacatgaaaaaattagccaggtgtggtagcacacttctatctatggtcccagctacttgggaggctgaggtaggaggatcacttgagccctggaagtcgagggtgcagtgagccgtgattgcaccactgcactccagcctgggtgacagagccagtccctgtctcaaataaactcattaattaaatactcatgcagtgagcttttctcccgttatatagaattatttgcaaatgtttgtcagtcaccacattctcctgggcaaagggcccactgtgttaactactcatcctctctggagtcccaccctggccaccgtgctgctctctgctttttaacctcttgattccgggaagcgggcgggggtcctgctgggaccctgtgcagggacaagggttcccggggcagttccctccacagcagggtgtgcatctgacagcctgtgctctctctctctctctcctcttgccccgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcgggtaagtggggcagcctcctgggtgggcctccctgcaccagccctccctccccagaggcacggagctgtttgcgagcgcatgatggtcttgactccccctccgccacccccagaaccgcccccagcatgcagcccggccgcgcacctgcagtggagcaccttgctaagagtattgaaaaatgagtgtaatttgtcctgtcatggttggtgcctttaagcattctacatgtcacatgttgttatgtaaattctctttgagactgaatgctggagaacagagaaatggttacagccaaagatgtatttctgatgattgcaaacatctggttattaaggaggttggaccacatttgccccttgaattcctccacagaaagaagtgaggttttcatacataaaaatcactggggtcgtcttgctcgcctccccagggatatcttggcttcaagggtcacgaacctttgcctgcaaagagaaaattaggtgttgagtcacatgcaaacatacaagaattaatgaaattggagttaagatgcgttgcagttgcgttttccaaaatggcatttgccttcctttctcctctgtgggaacaatgcagattagtttgtttcccattgccaatttggtccttctctgcacagactttgatattgccaggcgaatgtcaaggaatggtgtgaatgctcagtaaaagaaaaaaaaaaatgatactggtgtgtttggtggcagtcttgaaatgctagtctgtccctcttttaaggctcctgctagaatattcttgcacctctgcagccagggagaaagggatacctccaaggcagtggccctagaccaggggacatttgcaaggtctagagacatttttggttgtcacaacaggaatggagagatgctatgtcctctattgggtagagtctagggatgttgtttgacagcccccaacaagaaagaattatcagactcaaagtcagtcatgctgcagctgagaaaccctgctctatgttaaattcagcgatccccagaaagcctggcactaggcttccctggccagtgactggctttctggtgtgtagaagaaaatatggctgcatttaagactgtgtgaaaagggttaaatgcccttttcatagctctgttgcttgtaaatctttcagaaaatctacattagcctagatcatctattatactcatgacaaaaagaaacactttttttcattacatattcattctaaaccagagcatttgaaatgtttgtttcaaaaataaatgcaataaagttaatggtaaaaagaaatgagagtaggtaaaaccatcagagaagggaaagttaaggaaaagtagtaagacaaagtccatcaaatttcttgtgtagtcatttgaattgggtcaactttgagcttcttggacaaaacaagagctctctctatgcatacacatattttaactgaaaagacggtggatagtaacaaaccaagaatgaactggctataaattctccctaatgcctgtcaaatgtatttgtatgtcttaagccttttatgtgaccatgcaatataaggagttgtcgatagtataatttttatctctggtatcacagcaatgagcccattttatggatccagaaatgtaaaaataaagatttgttattcccaagatcatgtaatgagttatgaaggaaaaagaaaatcccaagttacctttgggctcatgtaattactaaagcaagatttgtatgctataaatccaaaattgcacttataccacattcgtttgaaaattgttctcagtacatgggagttgaagggttttagtatatctaccatcagtatctcactactatattgaagagcaaaagaaacaatagaggaaaattatatggtttatcctcacatgaccaatttataaacatctcagaatgacacacctgctgtaaaatcaaaattaaattagctaacttataatgaacatgctctttgctgggaataaccatgcataactaattaatgccatgtttcaccagggagagacacaggcatttccaaatgatgaaacaatgtgtttgtaactacttgggatgaaaattaattttaatattccagcaatatctgtgatcagtttggttatagtggtggattgtacctccttgctgataatagtatggctggcattctaaagccatacttggaagcaagatcaaattctcagcagagaagcaggagccccagcaggactaagattgcaagcattcatgtctgcaataacctattagagcaaggtactggtcaaaaagaaggaaattcgtcttgttgcctgggtgtttcactggattacagactcctgggaatgaattggcacggaatgaaaaactttgaggccaccatcttagaggtttccttttcctctggaataaacagattaggttgcaggagatggcaaggggatggctcctcttggaaaggaagagagcagagtgggacccagggcaggagctggctggaagagcaagaacccctatcttgtgttcagggagagcaagaacccctatgttgtgttcagggaaagcaagtagcatagaggttagaaatacttgttttcagaaagtaacatcatcaggattcaggtggtccagagagcagatttcctgtagccttttatctctaaattcctttggaggaaaactaagatttgactgacgtctttaccccagcccagtgcagctcaccctatgactcacacctattgtgttttaggcactgttgtgtgctgaagagacaaatggcaccttgagaggtatttcttctggttggggcagggggtgacatacaagccaacaatttcaataaatgtgataagtgatacaagaggatattgtgtgaacactagggaaaggtccttagcccagcttgggtgtttacagaaggcatcccagaagagaagaaatatggggtatatataagtccaaacatttcctaaattgccacagtgaaatcttatcctgtgacccctcctccacccacacccccagcaatctccatcttttctaagatgtcacctaacaaactacatttaagaatttgtttccactgtcaccaattgaaggcatatctgccaacctaaatctgttcttcctgaagtatccaatatgaatctatattgttactaaaataccagtcaaaaaggtgtcctaggtccatgcatggcttccacattttcttcctcctgggagattgaagaaaatatcctttaggatctccatggctacctttatggaagcttgggtaacccttggagatatccaacataaagatagtcacaccagtagagtccctaaggatgccctacattcatccatttccttttaaaaaaaattttttttgagacggagtcttactctgtcacccaggcttgagtgcaatggcacgatctcgactcactgcaacctccacctcctgggttcaagtgattctcccacctcagcctcctaagtagctgggattacaggtgcccgccaccacacctggctaatttttgcatttttaatagagatggggtttcaccattttggccaggctggtcttgaactcctgacctcaggtgatccgcccatctgggcctcccaaagtgctgggattataggcgtgggccactgcgcacagacattcatcaatttccttttattgatttgccttttccttccatgtcttgatattttctgaagcccttccatgcagctgaagaacatcggttatgaagaggcccttttttgtctcacatgcctaaatagaaacctcttgggacattaacacatgatcattcctccaggggtagggaaagttgtggaccatggtgggatcataggtacaagtggaaaaccctgtaccaaaccaaccaactcccaattgattgccaacatcaattgaatgagactgaagagttagaaagtaatgtctacatagcctatggaattttatagtcctaggaagacactggatttaaggtaaataagactgggccccaatattctacccatactggcttggatagcttacttaacgtctatagacacagtttgcttaagcgagagtgggggatatatctgcccccatagagtcgatagagggtgaagcagggaaatccatgtaaggtgacaacttggtccatcttatgacatgcattcagtgaactgtacctactgttctccaggttgatgaacttagcgactttattaaccacccacagtcttctttctcaacatcccccttttgcttgtggttgagtacaaaagaagatcccatgtctctccctctatgcattatttatctttgctagggggcacttgcagtttcacagacctccatttccttcaagccacagaaatggttgaggcacttgcattgcttatggaatatgtagattgaaaatacaatattgagtagggaacagtcacagagcagagtagagttttccttatttctccttgcatttgatcctggactcaatttgactgagaagccacaatgcccagtctagcttcctatgactcacatttgggaggaattacccatcaggtaattgctgttcagggagctcacaagctgattatctgtgcatcaagacagcaagtggaggctttggagacaaaccctgtagacttagtatctttgatgttagaaaacagcagctaaatcccaatcccctccctcaaagaggaactcgatgagtacctattaggtaccgtgcatatttcatgtgagtacaatggggtgctctaatggagcatcacatgagttatttttgagatggagtcttgctctgtcacccaggctgaaatgcagtggtacaatctctgctcactgcaacctcctcctcctgggttcaagcaattctcctgtcttcagcttcccaggtagctgggattataggcacatgccaccacacccagctaattttgtatttttagtagagacagggtttcaccatattggccaggctgctctcaaactcctgacctcaagtgatctgcccacctcagcctcccaaagtgctgggattacaggcatgtgccaccgccccctggccatgtttttattattattctaagcctaagcatctagtgtcagctgtaggcttttggtcttgttctctaggtatctctgagtaagattttctgccctttctcaggtaattgtcatacatctgtgtaaacttcccagagttaccttgagaagtatttgagaagactctatattatttggggtataggaaagatagagcagtatcccaggagaaaacttaaagctggtcagtggaagaacaaatagatcctttggaaatgttttcacgttaagtcctaaaaaagtctccaacaacagtctctgggactatgggcatatctttctgtgtacagatcagccatgctttctggttttatcttctaaatatctaaatccgcaacctgtagtatctgatgcttaggaactgtatttagtataaatactaggaacaaaagtcatcattacccattctcagaatactttagacacaggggcgtccaatcttttggtttccctgggacacactgaaagaattgacttggaccacacataaagtacacatacactaactacagctgatgagcaaaaaaagaaaaaagaaaaaaaagaatctcataatgttttaagaaagttaatggatttgtgttggggctgcattcaaagttgtcctgggccacatgcagcatatgggctgcggtttggacaagctgcctttgcagaattctttttataaagtgtgacttcttatttgctagttttaaaatgtaatccaaacagcctctgaatagcatgaacttatagacaaacatgatgaataagtggtctttaaagcctttttttggaggggagaatgtgaaaagacattttcacagatgcctttaataatctgattaaaaattctctaggaaaatacgtacaaacagcacacacacacacccaaattctatacacatgccagctagtttctgatccccccaatatccattaaaaaatagcggtatttgaacaccttaaaaagtttattttctagttggaaggggcctcagggtagaacaattgtaaacagccttttctataagaatatacttgtggctggtatatatcatattacacgagcagattgtatagtttgggcattttatactttttttttaaagtaaactaattttctgtagtgcagtcactccctgctcgcattcattcaaatatttaactactggtattacttttctaagaaaataagatgtgcatttgcattatgtccttgcaaaagcacattgagtcccgatgtgattgacaaacaatacaagtacctttgcatggctagacggaccatctctgcattgaaatatgactgcgcctgtttagtgcgcaatggtaactcccttctctcctaactgttccgtggttaatttatctatagctgcaccgcagacatggatccctgtgcctctttccctgcatatcttatattttaagtgcagctgtttgatgaggctttacaaattatttggatacatttttggaaactagcatgaggctttgtgatgagaactttcccgtaaccagctcctccattagaatataacctaggaggctgaccttcagttttgtctcaaatgtaaagtaaaataacacttggaggatggtgttgcatagagctatgattctcatattcctgggaccaatagcatccgcatcatctgttaacttgttagaaatgtaagctcttagatgctgtcatccggatctattcaatcagaacctgttggctgggcatggggcccagccatctgtgtttcaaaagtcctccaggtgattctgctacacattcaagtttgaccaccactgcctgccatagtacttaagagtttgcactgtggagccggaccccctgggctcaaatcccagttcagacaatacccaactctctttcagtttctacatgtctaaagaggcaatgatcatattgtccatctcatgggggtattctaaggactgagtgggatcatgagcacagaaaggctagactagggactgatccatggtaagtgttctgcaaatgtgagtagtgggagtaatggtgctcgtgctgttactattagggagaaaaacaatgttttggtaaaattggcttcccattacatggctttatttcacactgccggtgaggatggctacattgcttccacattttttagagttatcctaaagatagatcactcgtcctttccatttctctccaatacatgtgcactttgaaaacaagtaatcccttcatgatggggtttataatggcagctacaatcatctttttgctgtgaagccaccatatttagaccctaatgcttatacgtttccccccagccctccaagaagccagagcgtgggtcttccagccataggtcttgccttgcagtaccctcaccccaccaccctttgccttgacagcacttcactcctctctaccgagccaaggctttgaggtttctgtgccatttgcttagcctctctcgtctctgctgctggccctgcctccttccgttccacattcagggcacctctgttgctgtctcctgcagtatctatctcagctgtgattctacagttttatgcataatttgtgactgtgtgtcccacttcctgtacactctgggagggcagggttactgagggggctttcttcttcggtcttcatgccttcgcatagtagttggggtacaggaaagctttcagtcacagagaaatagtatgtatttggcttgtttgagcttttcacaatgagaaagctacactagttcttctttggttcagtgtttcatcaatgtaggatgtcagcaacacccaagtaactttccatagcccacagtggaggacaaagcatggcaatcaggttaccctactgagcagagactcctaagagcaaacatcccggcatgttctttcctcacctctgggcaatgttggtacaaataggcttgacatggaggcacaaaactggccatggtgcataacaacttgtcttaatgaaagaagggatcagtttcttggccagagctcagcctcagccatatcaaagaaccccaactcttggcccacacccatgccatgtgccccgttggaacagcctccaaggcctgggatcaattcttctctccgtcatttacagaagatcagagacagatgaggttccaccattgagatctttagaagtcattatttcccatatttaaaagtatgtttcatatctcatgaaaaatacattgtttacttctagactgctgtctagtctcttgccctggtctcctaattcaggttcgagtctgttaatcgtatttctcctccattgacaacagccactgatactgaatagccaaatcagagacaaacctcagactcctcccgacccattattgaattctacctggagttggtaaagcaatgactcaatctccttctgacgccttctcatgcccacccttccctctaaaatatgaaccctattcacccagttattgtccatcttctaggtaacaagcagtgtgtcaggaactgagaatagaatgttagttaagccacagggtgtagcttttaaggtgcaacgagtcacatgcacacagacctttaatgtgaggcagaaattgacgagtggctctgataagagtctgaaaaatgatgctggtgttcataatgggaaaagtcacccagctgcaggtgggcaccgggtctcaaacatggtgacctcgttagagctacagtgttaagcatgatgccacccatccctttgcaagcattatcttacgaaaccctttcttgaggtaggcacttacctattttccctttttaacagatgagtaagtgaggttcagatgtctcaagtaatatgtgcaaaggcactgcactgttgattgaggatgctgcagtctgattcaaatgcccatgtgcttcccatctaacttggctcttgaatggtcatgtcactgcttttggatgaggatactagaataaagggcattgccagcacaaggcattgcacgtgcaagggcatggcagcatgaaagaatgggatggagcggttttgatatggctaagtgatcagtcctgtggtttgggacccaaactaaatatctgttgctccctctctttcatcagaccttggcagagggtggctctgccttctgaccccccaaccgacattctctatgttggaaaagttgaaaaagaattcaaagcatagctcaggacgatgcacacctcagcatcttggattagggctttatgccacttcacaagcgctcttgtgaactgtagccctcccggatcaaatatgaacaacagctgaaagctattcctaccaacctccttagtgtgtgaaatccctgccacatttttaaggacaatggtacttggagtttagtcaatcaactctgaaatactctaagcagcacactagagtgttctccagcaaaccagtgtcacagctgcgtgtgtgtgtcagtacagcgtgtgtgtgtgtgtgtgtgtgtgtgtgttgtaaaatgccttcccttggctcaatatgctttgcttacatgtgggttcattctgctacagaaacctgctggaatcctttggtattaaagttgtgtttctattagaacctcagcttcattcaatggtggggctcattggtcctttgccagaatcataagtcatctagaaacatcatgggaaggtatcggggaagattgtaaataactatgatccttttaaaaataggcatttagaaacagcttcatatgcaagatgccttgtgatccttacaaaaacctgtgaaggctacatatgattctcgttaaactcgttttcatgcttaggaaatacaaatcagtttctcacgaccacgtagctaagagcttcttttcctggttgttttactcaaagcataccaaaaagcttctggggaatcattccctaacccctgtccccagccctctgaagtctcttctttctgggatggtcactacatgggtggcaatcagagagctgctatcagattgggcttgttcaatcaaggtgtgggtctttgtttagtctagatataatttacgtgaacatgcagatattcacatgtatacacccttgtacatataagtacacaaatacatataaataagtatacacatgcatatatacatgtttacatacgtgtatacactatagacaaatacatgcattcctgcacttgtccatattaacacacacaaatatgcacacaatgcacttgtacacatgaagacatgtctgcacagaaaacacattcttgcacatgtacccatgctcacccacatactattagagatattctccattaaccataaaataatgcacgtgcaattaccaaatataatacaatgtgaaagaatatagaagaaaatttttgaaaccatatgtgttgtccacctcacctaaggccattcagctctagcccatactgagaatgctgcaatctgtgtgtcgacctttacaatccgatttttaaatagatgttttgggtttttattctgtggggtagggggctatgtggtttgattgccaactctgacctgttaagatgctcatgtctgtctgggccacttaaatctcagtcctctttgcatttcaaagtcgtgcctttctgtacccactcctgagagagtgggaagtttgggacctagcacaccgccaccaccacatcctaattctgggccaacaccaaagcccggcctaattttctcggtttgctcaactgccgttgtctccaacctccttaatccaatgtgaaaacgatcctcggttcctgtgttttggatcttgtgaccagactaacctcgccagtgcaggggttggtgtgtctgcatgggaaatgcactaatatggatgtttctctttgtgtgtgcacccttgcagtgttgtttaccaggatggattttatggtgcagacatttatgtaagtattcattcacgtgcatgccatccccgtttcctcctggagtcattctttttacaagtttgctgtgaatttctctacttggcgtagttgagtttctctccttggtctgtaggaaataattccgtggtttgtcttgcaggacagaaagccttctgctcttgaacttgtggcagacatcactggctgtttagtggggtggaattaacccctcgatcaacttcagaacgaatgcaattcccccaaaaaggtggcatttctttcatgccaactaaagaccccacttcacccacaaagaaattgtctctcaagttctcgatatgttcttcgttttcagtataatatttaggataacagctgtagtcaccagctgcagagggttaaaagatattttcatggctgctatttttgatgttttccctaaaatatcacagtagccttaggaacactctttctctctctagacatggacaagtttagccctaaacatctcctgattctcttaatatgtatgtcaaattgaacattgagcccccattttctttaaccttttattccatttcccccaattacctgacttaaaattgcttgctaaatagtaacactttaagtttatttttagaaaagagtaggctatttctcattatgagaacaagaatttaactatgttcatctagaggtagttattctccgacattatgatatgagcattgacgatatgaaaatgacttggagtaaacacaattttgaataagtaggcagtgttgggagatattccctaaatcacaatttttattacaaaagacctcagtcaatgggattatatttgttttacagactagatagcaaaaaaatcatatttctgatgaaattggtatcatgtactagaagatgaataaggcactgattattgtattccttttgaatttcaaatcattacaattttgagatatagtatgtatctccatcaataatagacttagttgagttctactattgcatcaagtatacttactataatctgtgggttagtattttttcccccgtaataaaatgagtgaacaacccatatgtcctaattcactcagtgatcaattttcttcttttttgtggaacttaagcttttctgtctcatgtcctcttttttcagactttcagattttaaattatgaggcaggctggggctgagcagtctgaagcccattcatttcctcaggcacctgctaaacccaatcaccagtcctggctctcgactccatgcagcccatgggtagattattgcagatgggaggagccagaatggtagttggcatcgcagaatttagggctttagaaatgaaagggaatagacaagggatagagaaatggttttttaaaaaatccaccaaaatggaaactatctccagcaacacctacccaagaaaaaaaaaatgcagattttcctgagtttagttaaaagtatttcacaatcatttagtgagtgtccacctcttcacgcctcagtttcttcaaactgacaataatttattgaatcattaatgtgtggtgtcttatgcagatatcaaattggtgtcttcttggcctcagattcttgagtagcaggaaggagaggctgcctgaaggcagggtctgtggagctcccacaaataaggaaaaagaagggactcatttaagtgagtgcgagtgtgtgtctgtatcgattggggcatatcgctgcatcagagaatccacagagcaatgcaaatagagaaaaaacaaagttagaagaaggaaatatgccaaccacttgactagagaggaaaaagaaaatttattcagggaagaaagccacagaagtgtccctttgtgcttttctagttcctttaggagattttgtctctcacacattcatcatgtttgggccaagcccactgggtgcagcggtgcagctcgggaagcatcagggtgagcttcaaggacagagtttcttccagtcctaagttgtctgatatgtttgttcataaaactgccctttctctgacttttcaggccacgacccccagccagaaattatcgttttccccactctttatattataatgacaataagatttttcagtgggggagcatcacatatgcaatcaggtggcagaaaaagttcctgcaatatgaatttagagatttgattacccagcacatgtttctgtcctgtctctaacagtctctggaatctggtagaccttcctgaatattttgctttgtctgatgatgactttaacatattgctgctggtgtgcatccgtgtgtatactggacagcaggaaactagcctgtgccactgcccagctcagcagcagaacaagaggtctttgatgaccataagtttaagaaatataaatatgttctgcaccacagaatatacagaacaagattcatcctagctagaaatatatcataatcttgaatgtgctttttaaagccactaccctacctcccttgagataccagcatgttctgatgagtggaaatatccccaagcttcgtttttaaaagagatgatggttaaacagactcttagaaagtcatgtgagcttctactttaaagaaagattttggcttactccttcaagctcgttaaaagtagtacacaataaataggtttagggcaattgtcaacggccccgggatatatgttagacacatcagatacctcgaatagatttaaacctctttttgttattattatattttttgagacagactcactgtgtcgcccaggctggagtgcggtgcaatgtcatctgtctgcaacctctgccccctggaagcaattctcctgcctcagcttcctgagtagctgggattacaggcgcctaccaccacccctggctaatttttgtatttttagtaaagacaggatttcaccatgttggccagggtggtctggaactcctgacctcaagtgatccatccgcctcggtctcccaaagtgctacgattacagacgtgagccactgcaccaagccataaacctcttctttttaagtttattgggtagtcagtttctagcttcggtcactgctaaggaagacaaaggaggatactgtcagattcttcctgctcaaaatgttctccatcctggcagtatatcagagcaggtcaacaactcaacagcttgcatctcagaactactgggcttttctaggtgccctgctctctcccctcccccgtcctttgttcttcaaggtctttccatgcctaccacctgaggttggagccctcgggcattttttagttctgccaaagcacatagtcattgaaagacctgcgtgatccctgtaactggcaagccacaacctcttctctcaaatgacctccttctgaaagttttcagaggaaagaggattgaacagagagggacagatgatcacagatatcttgaaattgccaaagggagtagacttgttatgaaatgctgtgagccagacacgaagggaaaaaaccaggacagctcatttgggcagagagcaaagacaaagccttcaatcctattcaggagctgagccctgcaggaaacccactgcctctagccacagtggagaggtgcaggcacagtgtggttggctactcatcggaggtgatgcgggggttgtctgagaatggagggtaggaatgatctttatctgagtcccttctacctgagaacagaacagaacacacacacacacacacacttttgtataaaaagatagataggaatttaattttcataatgaaacatatcaaatcttttgatatgttcactattattgcttagtggtgcacctttaaatacattcattttaattaaaaagtggatcaagttaagcaaactaaatggtagagtttatacaaacagagttgcaatgcaaggactaaggttcttagatctacagagtctctcatacttggaagtgaagctatagatgttttttgaggtggaatctcgctctgtcgcccaggctggagcacagtagcacgatctcagctcacttgcaacctccgcttccagggttcaagggactcttcaacctcagcctcctgagtaactgggattacaggcactcgccaccatgcccagctaatccatgtattttagtagagatggggtttcgccatgttggccaggctggtctcaaactcctgacttcaagagatccacctgccttggcctcccaaagtgctgggattacaggtgtgacccaccatgactgacccctgaagctataggttttatgaggctagaagttgaccaaggagtggaaaacaagcattgcttaactgaaccaagacatctgttggttgaccttctcagaaagagaccaaaaagtatagcatttgatcaaaagataactattaatattacaaatgaaaagagggagagaaagaaattataatgaactgttaaaaagaattgacaaacggatagaaactggaataacatagtgaggtgtgacaatggtaagagcagagagaaagagtgagaggatatagagtataaatgttaaccttgttcctttttattaagaacatcctaagcgtcctaacattagacgcaaccatgagggccgcctagcaaatatgtcttgagattccagtgcatttttataccattcctaaattctgtataacaagtttctggttaacaccatggctaaacacaattatttctgaattcctgtcactctgccacccatatgttttaaaacaaagaggtatcctcatttcactgatgtttaaactcaggaatgagatgtgtcagtagctttgggaacatgtaaagctggaaagtaggaattctttaaataaaaactcctagtctttcttcctgagaccttgctttcagtgtgaggtggctgaggattggcatttgacttgccgtccgcagtcaccatagtggagacctcagtccaccaagaaatcaggcgaatgctgtgtttgcaatgggagagacaagatgttgagtgttttacctgtattacgtcatctctcctcaccacagcccttgaaacaaggaatcttacctctatttttctgttgttccagaagagaaacttttttgggagacatagcctccctgtatcacccagggtggagtgcagtggcatgatctcagctcactgcaacctctgcctcccaggttcaagcaattctcctgccttagcctcccagatagctgagactacatgcatgcaccacgacgcctggctaatttttggatccttagtagagacggggtttcaccatgttggccaggctggtctcgaacttccgacctcaagtgatccagctgccttggcctcccaaagtgctaggattacaggtgtcagccaccacgtgtggccaacaggaaacttttttttccagaaaaaaagaaaataatttgtccaaaaatcttcagacactgggccttgagcccacatgatttgactactgagtttaatgctgaagccctgagcccacaaactcaagtcattgcgctagttgagcaatatttgaaaagtacggtgaaagatgggaaaggaagagggagagaagtaaaagcataacggggtggttagaccactgagaataatatttgtactggaaatattcaagtaagcagtgaactaggagcgaaaggaggagagagaggaacaagaatgttatcaggcatcgctccgtaagcttagacttttaacataaggaagcaaatttaaactggaaaggcaggctatgtaggaaaaagtatacacaagcctttatagggtacgtccctcagtctcttcaagtgttcagccatctcagtgtctgccctagaattggagaattttatttcaaactgtgaccactcacatggaagattaatcttgaccatgaatgactcttatgtcaaaaaactgcatcctagtccgcacaaggattctacagagaccttccttgccagtgctagatttgtatgaaatgatagcattttgatatgtatattaacactagtttacacacacgcacacacactcatatatactcacagttctctagtctgaaagtattaaaaggagccatcgtagcttcagtgtaattcatgaattcatgaactgcaattttgctgttagttgaaattaatttaacaagtaaaggcatttatgcagttatggttgctactgtgctgttttcttaactacttcaataataaggcattcatcttaaatccttagatattccagaaaattccaatcatgagataaagagatgaatgtgaaatagttaatttggactgttggaatatgctttaagaggcaagaagccatgaaattatctttttcttctttagaaataaacacaagttataacacaaagtggtttgatccccatctccaccttgatactctccattgcagagatttgcaactaaaaatgtttgtcgatgcccagtgcccctttcagcttggtgggccagtcccaaggcttggtgaagtaagagagaagcaaacttgtaaatgaattgctctggaatttgtctgacttatgcattctcttttatttatttcatttttgcattgaaaacattacatttctgtttccttatagagtagtgtatcaagagcctgtgtatggcaataaattgctgcaggtatgaaatcccgactggtggagaaactcatcactatgattgtgggtttgctgtgaaatccttactaacaagataattctggggaggggaacagttctctaacataggaggaaagacttaactgaattttccagttttaatatgaaatctcctagaatagaggtgaggtggctatccctgtatctatcagtatatccactgtgttgtggcagtttcttccaaatatgggtgctgtttccatgactgagtgctgttagctggcctcagccatgagctttgttagatcctgagtgtgtcaaatggtggtctagcttggctgttaattttttagtttaaaagctatctggactcaatcagtataaatccaatgaaaataattcaaggttctaattgaaccaattgtctggataattttttagtaggttcccagagtgaaccggaatggggttaaatcaagaatctcatgtgcaacattaagggccagcatacctgacatctaacataaccctccctggtcttagtagagctgatcagaaatttatttcaagcctgttgttatagcttttaaacctatttctcactgctaaagcaaccaccaactgaacaaatttgtaggaagaaaaaaagtcaacatattcattggaatgtggctggcctagagtctccaaatttggtctattacccacattgaaaccgtcaaataagatgaatgtcaaactgaggatgatcagtgagagttgtaggacattactttccctatctctgcaattcccttttttcttcagtattatgagtgaattacgaaagtactttttgtaaaccatgagaattgactgagttttaattaaaacctgaatgtgagaaagaggtactttgacctagtaaagagcaatatggttaaaattcctgagatgaactttcactgtcacatttcaagagaactggacctccaactgccacccttcaaaaatagatggatgtggccaggtgtggtggctcacacctgtaatccccgtacttcgggagacctaaggcaggcagattgcttgaggccaggggttcaagacggggccagccaggcctatgtatcaaaaccgcatctctactaaaaatacaagttagccaggcgtggtggcacatgcctgcagtcccagctactcgggaggctgaggcaggagaatcggttgaacctgggagacacagattgcagtgagccgagattgcgccattgtactccagcctgggtgacagagaagactccatctcaaaaaaaaaaaaaaaaaaaaaaagaacatatagataaattagggagataaatttttcattttaaaatgttcttataagtattatatagtaaataagatttaagttgtatgtgtatataccagcacacctgttttgcaccaagtgagacttgacccttgcatattttcatcataaagggagcctttacccctagttaagctgatttactttcctatgcactccagctgaaggaagcatgcgtaacacgtacatgttacagtcctaccgacgcccacgtctccctagcacacacaggtttcccctcccctatttcactgtttggccggtagaacatttattttcaaaagtgatctaaagtgaaaactttgatttaagcctcaaattctctgagatgccttggaggtccctcagtgttcatgaatattgtcccaaggagttccacaaacagagtaaccagtttaatttaactgagcatctgccaaaccagtttggttgtggaaattttcctttccttgccaccattaataccccacaagcataattttgaaactgctttattagctaggcacagtggcttacacctgtaatcccagcactttgggaggctgaattgggaggatcgcttgatcccaggagtttgacagcagcctaggcaacatagtgagaccccatctctagtagtaataagagaacaaaatgctttattggagcatcatttgaggtgcttaatgggtaactacctcaaaggacctctagaggttttgctaacaaaggaaacttctcagtccacatgagtggatcactttggtggcctcactcatttggtggtggtggcaacaagatgcacaatgacaatttgaaatttttatataaggttacatttatattttgctgcccatcctgtgaagaaataaatgtttcatgaatgggagcgtagaactattttgtgtttgtcatgcctcgttcctttggtttggtggtgggaaaaatttaattgtcaatgacacatttttgtcaaatgatctcggaagaccaggttcaacatgaacatggtctggtgacagcaattgaaagtgagtgttccttttacagacatcactgtggaaccttgaagaagttctggatatgctcagtgagctgcaaaatacagagcgataaaattgattcaagtcacctgttaggaaaattaaagcaatttgtatttttgtatgtaaagcaatttatattttacagtgtatgtacacatacactgagttaatacacaactcttatttccctagtatgaattgcatacagaagaaaaatagcaaaggaagaccatgcagtaaagatagaggagagataaaaccaccctaatccctttttccctaattattacatgtttcagggatcatttaggctggtattgtccaatcctttggccaccagtccccatgtggctatttacatttaaattcaaattaactgaaaagtaaatttaaaaatcagttcattgcactagttacctttcaagagttcaatagtcatttactagaagtagctactctgttggacagcacagatatagaacattcatctccaagtggtctactgcacagcaatgagaccactgatcaaggtttaaaatctctccgctggctctggagagttaaggaaattgtgatcttaaccctggaatcaggaatgctcacaagcaaatttctagataataaagtcataaataatatcagaatattgacgacttgtgcccgtcttgtctggaaacacacattttctgtaactggccaagtcatatgcaaacagagtagaggtcattttgagaccttcatagatgaccacatttgctgtgcagcggaatcccaggtgtacacacctgcatttgatgtttctactatacataacctactagtcagtgtggttcatttagttgtttgcaccgcagcaattcttcccatttatcggactcgctgccttcttccattgactgaaactaaggcagaaggtggaggatatgcaaagttcaaaccaagaggcttgcaaataggatgttgctagacatctttggtgggaccaaattcagtcaccaaatcatgattcacatggcatctgattgctgcaaatactttttcttgttccagagagaaacacattcataccacacacattctctccactcaaaactttaagcctgttgcagctaatgtcttctggaaatcagctagccagttctagcccctccctacctcattaagtttaatgtatgtacctgcacacctgtatctttctgtgaactttatgaaagccaagaagatgaacaagctatatagaaaaatggctccataaacctggtgacccaatttctctttagtccgtcactctgttgaactcagtgctgttataactgctttggttttataactcctcagcacatttaatgagttccccattcctaattggagaacatagtatttggaacaccaggtggcatctggctaagacctctttttgttgtggttaacttccattacctctttaagggaaacaaaaaaaaaaaaaactggttctaaattattggtgattatgtggcaggatgttttggatgtgtcttctccaggactgatccaaagaataaactttaaaagataaactcgtttctttgaattgctgtgcaaatgatagcatatttactctgaaagttaactgtgcaggaaagaggcagaaagaaattgagacccgtgtacctacatcttgaaagaggctttttgtagcttccctgcttcatctatgtcttatcgtatttagtttcatgaagccaaatgccatgaacctacctttccctctcatgattctgctgttgtataccttctcacacactactttgtcctgagttgcccctttatggtgatggtgaggacacttacctcagaggattatgggactgtgtgttctaattagaacctgaatggtcctgtgttatcagcggacactggatcctgtttaactgtgctgagttcattgtacactggttgatgtatcattgtggtccactgagcaagaagctctgttatattcacagtttgatcatcaacgctccactgaacacaattccttttgaatatgcctatttgctcgtcctctttgcttaattgaacaattgcaattactggtacatacaactaaatgttaattattttttcttttcagattttttctgttaatgattttatttacaaattagaagactatcatattttccacaccaaacaaattctccgtctgaagcagcatgatacataaccatgtgatatctttggccaaaaagaaatgttcagtcatttttgtaataattgtgtaacatttagacagctacagacattcttcaataacattagtggtttaacaaccagataggtaagagattactaataaactttcaatcaaagggtgatttaataaatataaaagacaggaaagcattcactttataagaaaataagaactgtttgaataaaatttaagttaatatctgataaaggtaaagcagaaacaattttgaaaatctggaaagttcagcaaagtataaagagtatttaaataattccccataatcctctccaccccaagacaatcgccattaacatttaggtacattttcttccaagggcctctaggctcttcttttgggatgtgcttatgaccgctaacctttaacatccagctggggttggtattccaccccttgtttctccagggtgtttttgtattttcgctttgatactaagctttcattaacctcaactttagctcagtagatttgggtaacagctgctctggtgtggtcttgccactgggcatccctgcattgggctccgctacattcctgagtcacatttctccttgtgttttagggtggttatgctgcataccgctacgcccagcctacccctgccactgccgctgcctacagtgacaggtaagggtcatccttcttgtgcttgacaactacttgtaaattaacttagttgatgggagaggagattcttgtatggtcttggtgaaactgcatgactgctgggggaggtagcaccccaaaagttaggtcccatggtgaacgtgaactcaagtccccatagagagagggcaaatgcttcagccaattctaaactactctctctgctgagacacaaagaaaatgatagccttggtccttgtgtagtttttcacatctcttaatttctgtgacaacgcaccttgctcacatacacatacacacacacacacacacacacacacaccgtacaaccttcttatggtcttccacataagaccacggtttcatctaactcataggaagaaaaacagaccatgatcctacaaggtttacttcaatttcaagcccctttcctttttacaaggtcttatacccaataaatcattccctccattgcattattacaattctaaataaaggagagggagagtgtccctggcattcataaggagattgattctttctagcaatgcccagtgtccaatcctacaaacataagccagcttttatttgtaatgtacaccacatgttaaggcaggcagtggaaggaacacagtgtgtttgaggaatgcagaagtcagaatggatgggcaggttgcgggggtggggtggaaatcaggggtttctatcacccaggctgaacagatgagttggttcctgaaacagcaagccgtagctacttttgtatggttgccttgaaaaggaaagtgtgtgttttcatattgaatgcaactccttggctctgttttctgaggacataaatgtgaatgttcagatgctctgcatgcacaaatgtcattgagggtgcttattttggtaatgagtcctttattttaaaaatatgtttcacgaataaaacaatgataacaatttgcatgtgtggctggggcatgctgggtcagacaggtaagcaggcgatgtatttgactcctgaatgggaagcgtcagcagcctctggtcctcctacctggcctgttgtgatgtagttcctacctcggtttgctgtggtgtgctttctctgcagttccattccatttctcacgagacgtggtgttagctaattgtagctacagaattcttgcaatataataaagcagaataaatccctgaatcctaaaagctgcattttgaaaaccccatgcatacacttgtaacaaatggctctttggcaagatggagttgagatctgctatctggttctatgcaggtatcattttcttataagcagccataacaagttctcaaggctgtagggggccttcagagaaatccagacaattgtcaagacaaggttctcaatacataaattatacatttaccgagtaatcagttgccaagatgcaaaatgtgtttcatgtaagttgttatctccaacacactttgacactggattaggaaagtagagagggtcaataagactaataaaaatgatgacaatcttgaaatactcaagatcattctacaaaggaaaaggcctaatgttattaaattctgcactgaagcttcacaaagtatcaattgtaatgtggttcagctgcaacccttaattattttttatgaaaatatctctagatgctaaattctcaaacacccactttgtatataattataatcatagtaactctagcctgctgtataattataagaatcttaaacagatttgatttatcttgcttttcagtataagtgcatctatccccaagttgaaaaaaaaagattacaaagatatgatttaaatggactccttcaataagactggtctagacatttaaacaattaacaatatttaatgctattagaattacctgagattctggccatccctacttgcattcatctaaacatttttaaatttctgcattttggaacaccatacatgtaaaatctgttattttgatattattcagatttctcattggcaacatgtcccactgaaagattgcccttgttcttggattggtgaatctttaataactgcaattccaactttagtaccatagtttcagttgaagaaaccaactaactaatactgttgtccatataattggcctcttgttgttcattagagaaatttgcacatttggtcttcttggttgctgtggaaattgataactattcctatttaactttatcataagcaagacacttgccacatggtattattcattgaagtaaattaattaataagtaaatggacagaaagcaatctttaaagttgtatttctgatgttttaaaatgtctattaaatggtgctacttccttttatctgtaataagcagatattgagaaagaatacctttttatagaagacacgtttaggggaaaatgtgaaattatcagaatagcttttgaatctagattaaagatgccaagtacctataatttctctcagaagtagcaattgtgtaaccaattatttttatatcatcacagcatagaatcagtaagtgatggaagcttagttcctcttctgtagaagacaggcaagataaagaaaaacttaacagaaaaacttcgtccaaaataggaagtaaaatcagcaggcattgagaatgttttggtaatgctcactggttgtcagttgatcaaaagagaaacagcaacaaactttccctgtaatcatgagattcactcttcagacatcttgaaagcaaaagaagtttgatgtccccagttggtaggattttaccttttttcagcacaaattaagccctcatcaaatgaaagattcagggatctttgaaaaatattgaactccagtaacctcaggactgtccagaaggtccttaatgggcaccttgcaactccctgcccatcatcttcttggttaaatgatcacatgctgattatctcggagcaacctgagagtctctgaatgttgacctccagaaagaagaccatctggtgtgggcagagatttccccaaaagaaaaatacctgactggactaggtaattttatagtctcattgacaaatttaatgggaataggtgaacatcttttcttggcatttaggaaacatttggcaaagcacttgaccttcaccaaatctttatttctaatctcactttgatttatgcaaagccaactgtctgaactttcaaaggagagcgtttcctgagcttgaaccaactgaagcatggcagaggggcctttggtcatccggtcattgcatgccacttggtgttgctgatgtgtctgtgatacgttctggattggacaggtccatcacatcagcttgatgaatggcttgcttgaattaagcctgggggcaggcttctctttattgattggctcatggtttgtgtattatgacttggttgttgttgcatcttgaagcagccaaactgggaggtgcggagggggtggaaaagattccctgtttgatcaactgtgccacaaatatttgggaaaatgtgatgtgtacatggctttgatgaaagtgttatctccccagacagacagacatttgtcatgcttgtcctgcttgctaacactcttaacatttcctaatgatcagtgcatgaaaatgtccctccacgtcagggctgaaagtagctagatgcagaccgcctagagacggaagcaagacagtttttcactcagatttcatcacagtccaattacactgatagttaccaggggccatttcttccacataaaacatgcatttcttgtaaagatccatgaaagccaagaagcttttgacattaattgcggcaccaggccacacaggtatctctaaactgagcaaaagatggcaaccaacataattttgttttaatgtatacctttttggattctgaggccttaaagtttcactgctaatgtagagttagaaattgctacttttgtgtgacaaaaatgacatattggctctgttgtaatatgaaaatatacatatatctacataaatgttacgtagctcaacttaatagaaatccaaataaaatgccatattatcttcctctctgcacacacacacgtacacacacacacactcacttgtgccttggggcctcacaagggacttataagtgttttcaggtaaagcttaatgcaaagagaccagggcttgttaatttcaagtggtcacaaactacatgctagagaacgtaagttaaatatgacattcataacctatgaataaaaggttctatttcagagacagatttgtgtttcttagaacctagtaaggataagtaggcatattttcaggttcatagaggatttagtcttattttaaaattatttaagtgacagagatagacatatacatacatccatgcttacacatacatagatgggtgaaggatgggtagatggatagatggagataaatcgatacataggtgggtggatgaatggaaaaagagggaaggaagcaaggaagggaccatctttctgccctctaatatttcatcataagctaaatacagaaaataggactaaatccttatgcacaaaagattgtacaagctgaactaaaaaagtaaaaggatttgagttgatttccattagcgcaggctacttcctgtctattttagaatttttctggcctcagattaagtagtagagaaaggctgtcatgaaaatagacaggcaaataagtatatttacagtgatattccattttaattggagttcttatccgatgatatatactaaaaattaaggaattgtcagcatataaagtatatgagcatcctgaatagaaaatttaatttaccatttaagggcttatttttgtaggaaggttaattttttaagaagatgttgtattttatggacattatgttttcattttttttttcccatgggataggatatagtttaacctgtggataatttggaacccttaatgaaagtacacatgcaaagcagacaaagggggcacttgctttgctttccccagtcctcttatctgaaccaagtttgatagggattgaaaatatttctagctaaacagcagtagcagcccttgttcttattctttgtgatgtgtggcaaggagagatctcaagatcttattctagtgccgtattgaaagcagtatctcccaaggccagttcaagacctggcacctgcctttgatggcatatttacggtttatcaaaacggaagaacaccaaccatgtaatatggttgtcaaccctcttttctgggaaataggctgtatctattcttccttctcacatgctgtttaaaaagatttataaaattagaacaatagcaaacggtagttttagacatccaattttgtttttcatgttcttccttggcaaagtaaacattggcaactttatgctagactctgtatcattttatttacatttgcagtctctgagaaatctgttggaaaaatatagtgagagcattgtaaaacatggccatgccagagatggtattctcagatcaacaaggaactgaggatggagttcttgggggttcagaagggatgggagagttttccatgccatcttcccagctgggatacagacccaaaggcagagagaagccacttgcaagtttgagtctaggctgtggaatcaatacgtggcaaataagccaaagtcatatctctgtgccatttttgatggtgctttgaagaagctgttcttggttttagttttttttttttttaatcttttatttttactcaacctgatgaactctcttgggttctataattttttttaaaaaaaagatgatctgtcaagttgtaataagaatgtagcagaaatgagtcactcatgcctttatttacatcctcctgtgcccctgtgtctagaaaagcacgtccaggttttagttagaactccaggttgagcacgtgtacatctatacatatctacatgtataaacacacactttttcttgttcatttaaagtttactttcctaacagatccattttgttgttgttgttttttggggtttttgcctattcagactctccttaggaagaaaaagtgaaagcaattgtcctagacagctttcgggtaactagaaacacacagttatacctgtgagattcctattacaaagcacacatgccagataaatttcttaatacttctatgtgtgtgtgtgtgtatatatatatatatatatatataaaacagtgctcctcttaaagtgatgttgattgtatattctccaaaaaattaggataactaagataattctatttcctcctgatctgctctgtagactgtcactgatgtatggagatggctctgaaatagtgaggaagggaaggtacatctcagcttttgatagtagagtcaccgtaattttttaaaattgggtttatgcatgtcaagctctcagtactgagaagtaatatggctgtaactgatagatatatttcctgagtttctcttagtttatagaaatcacacacacacagagacagacagacagacacacacacgttaaaagaaaatgtgttcaactttctctctcaagaactaattgcctttggtccataatctataatggcttcataacaactgttatgcactattggatgaatatgtaattgaatcagtttaaaaaaagaaccaatcctgtaacagtcaacagactggaccaccaaggagttggggagagattaaaggaatttccaagcccaacagaccgtagctgtcacagccacgtgggtagacacttttgccagtgacaaggcaaggtgtaacaactcctttggtcatgtcatggcctaattacacactttttaggtcgcagatcattgacttgataggccacaaaaaaggaaataaagcctgtcttttcagtagcagcatcagaacccttcagctgtgaagggtttagaggcaggttgggaaagcctaatgctttctaggtgtagctctgttgagaatatacgtgcaaagccctatgaatgagccatttctattgctaaaaaaaaacctgcattctagaagacagtaatccagtaaagcagaagatagaatatcttagctcatgcagcatttgtggatgtggcaataaaaattaaaccgctccactttgttacgttgttctttgtttgggttttatgtcactaggtagtatactatggatggtagtatactatctttcaagataagatgaaatttttcagtaaaagtgtctaatatttcattttaagttatcaaagcaagttctgactctgtacttaccacaagttgaaattcttttccagaagaactgatttctatttcaatgtggcctctaatttatttccacttttgtgtgtagtacatgcatgtaagcagtcaccagacagaaatgacttatggcttccttggtgtaaatcacaatgcttggttcctgtggaattaggcacttctcaaaaactatgatgaatttcatatttaattaacatatgaaacatttagaataggggccactattggaatttgaggggatgggagtctgtggggcaaaaactagggagaatagaaggagtaactagtcacttttctttttttccaagctaattattgatacattatgatgtgtgactgttcaaatagattaacagatttctgaaagctgaaacataatcaaagccaaatattctcgtaattatcccaatcatttagattgaaatgctttggcctgagattatagaaatatgccacacatatgataagctaaatcagtggttctaacgggtcttggggacctggaatttaaagaaaaaaaaaaacatgattgttagatgcttctaacatcctctcaattcttgcctttcatggtttcaattttgtaatttaaaattttagaatgtattaagagatgaagaacttgttttttccaccatttctgctttgttagagtgtttgtggatgactactaccaaacagaatatgagcccaggtagtgggagtggaggcactttaataattcttcctggacaataccagcttccctgttttttcagaatgatcgtttccccactatttttgttttcttccatttctgtctcccaaacttagaaaatgaacaaatgggggaaaaggaggattaacttgttctgttttgaaatttcaagatttgagtggatcatctaaaaagcctgcagagccttgccttgtaaagtgtagtttccagaccaacaccattgggctcaccaggagcctgtgagaatgtagaatcccaaaccccagtcccagccgtgctgaaccagaagctgcacttcccagactccagaatgactagtgaagtttgagaagccccactttagagaacaagcttctgttctaccccgatatgccataatgttgacaaagggttgtcctgccacaaaccttgcaagagataagaggatctatctttataaattattgacttttattaccattgcctctctactctcccttcttcaatgagagagtaagaactatcaacagctgagtgacttcttccctctcctggcccagggccacaattaattctttaccccaaaagatccgtggacggaaacagttatttatgctaacatcgtgtcattaattgcatagattcacgctaatataaaggagtacctgaaaaagttccatctgatttcactttactgaccctcagttttttcctatgctaagtggaaagcatggtactaattagaatcagaaagagatgaagaaggtgaacattataaactgaaagaggtggtgcaaatgttatcaataactcggtttcagattgacatattttggaatgtatgctagtatttgcagtgaatatatagaggcagtagcaagtacattaaattaaatgcatttaaaaatgtaaggttatttttagtctaggcaatctctaagacacactgtaacactaaccctctgggaacctgtgccttgcttagcatcccaggtcttgtaggtaactgtgtcaagatttgaaatcagatcttttattctcattggacctactctgatatagacatgcactagcaaatcattgctgttgatacagagaataggattacagattgagatttacacgtgggtcctgaatctctgtgaggttacttactacacgagataatttgggcaggccaacattgagctagttgaccctcaactgcctcatctataaagtgggattaatggatgaccattgcttctttgcgtggttgtgagaatccattgctgtcatgaacagaaagcccctctaagagatcctgacacttagttctcaggatattagcagcagcagcatcactgaactgtgggattatcgtgttctgttctcgagtgaaaaaaaaaacaaggagtttcctgtggaaacgggttttatgagttagaataatttttgactaaatacatttgtttttggttgttttaaaatcttgacttctaccctagaaatataaacataggttggggaatagaaattgggaaccgcaagatcaaatatcctatccttctttttcaacctgtgccttggatatttgttatcttttctgctcatggatcagcttaggccaccacacatgcattagctttgtagaagaaatgcccaatctcccagtataaacccagccttcgaactatcaccgctttggatttttgtaaaaccaattgcctgccctcttctttgggtggagagagaaagagactttcctttaggagtctacacagacaaaaaaagaaaaagccaatttttctaccaataaaatgacttcacatttgtttctcattcaacttgcacaaaaggtctgggaagggcatgtactgtttttatatctcaatttttccaaatgaagaaactgaggtccagacaggtgaaatgaattttctattggaatacagcttatatgcaacaaagcatggttttcagattcacggttggttctctttcacctgagcctagacaagaagtgcagtgggaactggggagaatgttaaatgttggaggaactaaaatgacaaaagggaactgttcaaggtctccaagtaatggagatgaacttgggtttgaatttccaaaactcagatctttttttggtagaatagccaaactggggagagattcacagaccttatcttctttctgtttaagcttctttacgaatatcatgttagcaataggaactgtgtctaaatgaaatgtttttaagtgtattttcatgtgttcccccttttcaaaaagagataggtgtaggacctttgagagctttctataatcaatctgtttggttacttgtctgtgtataccctgtctcattctacaatttgccacagtgtattgaagtacacgtgacaacactaaactgaataaaagtgacagggcaggtaaaaaatatgaatctgaatgggatttgtaccattctggagtagagtattagtattttatgtggaaaggaggtaaaatactgattgcaaggaacctccctttgaaggtgataaaactgaaatataaattagattatgagcttccagacaggcaagtccaagatactccagtgatttaaaggatatgagcatagcatcagaccccttagacttagctcagtgcctgatatgtagcaagcccctcatttacaatctgagggctgaatgatgtgagtcaactctttggtaagatcagcaatatgaattttaataggtacatcctatctgcatattatgtttaatattcagaaaacactcatggctgagttccatatggcacgtctagcaattttaacaacaagaataaactgattattgtgactttccaccttaattttacatgtaaaaaaggaagcaacctggtaagcatgattataagacaattactaattataactactgtaattagtataattagcaattaaaatattaagtataaaatgttaaaaatcaacactagtgcaatttaaacccaaaagacacaactgtttcctgaagaggcaagatacatatgttcagagaggtattcatacagtgagatgagttctccgtgctggctgacagatgagaatcaaccccaggggtttttcaggcatatctgtacatgggaaccactctcaaagatgctcaagttaaatgaccggggtgtgggcctggtcattggtattttatttaaaaaacaatcctagctgaatatttattaaaaaacaaagtattggctgggcagtcagggctaaaaacctctgccttataaacaacagatatcccaatacgtacaggtagaattggattttgtcccactgctatcctggggcatcttggctgccatctaccaggccagaagaccaacttctcagctgtagggattgcctagtaggcatccttggcaggtttaaatgtgtgtgtgtgtgtgtgtgtgtgtgtgtgtgtgtgtgtgagagagagagagagagagagagattcaatattcatagcattggatacaagaagaatcttgctatgagtgatatcgatcctgagatatatttaacaatagcaatgtaacagaattaagaagccaaataatgagaagtgagcagaatctttgcccataagacttaaagacagtattatttgctatggggaatgtttacgtcccacctgcccgcaccaaaagttttctctgacttgatatctagcatctcatgtcccctccagcaacacaggctggctactgttttaatttaactctgagaattcagctgtgggtaatttttcagaaggaaaactgccaagagatgagatttaacctaaggaacaaaagtgggctatgagggtgatatgcggcaatccacaggactaatttaagtgtaccaccagctgaggcagatagagtatagatggttgatctataaaaccatcttaaaagattagtcaggctagtgacataagagtgaaagagacagaccatggcatatgccatttcataatcaagttgttgttagaatatgtttttaattctttctctcaattattctcaaagaggagttcaaatatttcttagaggaaatgaagattcagaatgttaagttactccacagagacatcacacctcactgctgattaaataccccctacgtgaatgttccaagcagaaccttagatagtaaaagcttggtcttgagccaagccaactgtgttcaggtttcacctctaccacttaacagctgctcgcattatgtaacttttccatgcctcagtttcgtcatctacaagacgaggataaaaagaagggttataagaaaaattaaatgaatacataggtatgacacttggcaacttgcagtcataagtgccccatcagtgttagatagtagccgttgcaatcaacattcccatgagccaagacaaacacagccttctcccttaaactcaatttggccatttcatcatttttcatacattggtaatccttcctcttctccacccccaaccaagccttcccagttcaaaataatcttcctgggacaggtgagctttgaagtgaaaatgggaatgaacttgcagatttttcagcaaggttgcccaaacttcaaggtaagaagcagcaggaggcgtgattccctcacagcagaatctgctacctacagaacagtgaaaatgagtgcctgtggagctgatcaacaggcaggcctgagttcttattaagtgtatagattaccagacctctctcctggaaattctgattcaggtggtcagagttgaaacccaggaatctataccttgaatgagcactctaggcattcttatcttcagggaagttggagaaattttggagtggaagagaggtagaatatagaaaagttgtgggtgacaggaatgggaaaatacagaagtaggggccaactcaaagaaaaatggaaaaacccaagcaaggatgatcttgagtaaatgcataagaagtggtccattaagaggaacaggtaaggaagaactcaaataccaagagtatgatatggccactgtagagcagtttctctttcaggatgaggtttaaagtcaactcttagaaggcatctagaaactagaagtaccctttcttggatactgtatcaggtttgtgtggttgcatagtctaaaacctaagtagctaggttgccctggaggcaagcatggtggccaaacagaagctgcaaaagtagaaaccaaagttggaagagattcagtgattcaactcccttgaatcccttccttgaatccacttccttgaatctcttgaatccctctgccttggtgccataacactgcttctcagctgggccacatattagagtcacctatagagcattttccgaactactttccaggccctaccccagatcaattaaagcagaaacctcaggaatgggccctatcactggcactctcttaacctctatgaatctaaggagcagccaaggtgaggaccattcacctcaacaagtgattttcaaacgaagaacgttagcacattagaatcacttggaagcatttaaaaactgctgaggcccgagacccagtttcagaggttaccatttaattggtcttcagtgtagcttggtaaccagaaatttttagaagtgcaccaattatttacaatgtgcagccaaggttgagaacgactcagccagacttgttttatgaacaactaaggaacagaccagtttgtggaaaatcaggtgcattttgaagtttaaattcacgggtctgtgttgagagaaagcagcacactagggtttgcataaggagacagaccctggtaccagccttctttcttctcctgagaggcagccccactgtccagaatatacctgcattgttctgatcttttaatttttctgaagttgtttggatatagcggagacattcgtctctttgatcatatgtgtctctggtcatctggggcaaatggcttgagagagggtcatagatgatccatttatgggccctctaaatcaatagtcttaatgttcaaggtgaaacagctgtacataaaatggcataacatggtgaatatagacagcaacatgcaatctccccttagaactgtaccagaattcttctgttgtcctgacactgcaggccaccaaagccaatctgattttacagacatttcctgttaattgcacttaccgattgatgaaagcattgttcagggaagtagtgatcacacagattgaattcatggaattaattaatgaactctatagaaaggcactttctgacaccttatggtgacctttctgggatgtagtgggattgtttatgtggattaaaaaataaaatagtacagaatggatacgtcaaaaaaatacttaactggtagctgttaactccttttaaatgtcactattattgagaactctgccttgaaacagatgtgaatttgtagtcagaagtaatctaagccaactcttttgaagagggtgagttgtcaaagggagtagtcccttttgttctgaaacttagggatcaagaagagaccaggggtaaaaaataaaataaaaatcaatacacataggttttcaaaaaaaaaaagtgggggagagaaagaatgaagggaaaatgaaaggagagaaagaacggaaagaaaacggaaaggaaaggagaaaaggaaggaaagggtaggagaggaaaagaggaagaaaggaggaaggaaaaagggtagtttaaggttaagtgcagactcaaaaagaatactttcaaggacaccatcatactataaaattctgaaacaatttttaaaaacaagcctagtttcttagagggctgtttctattcatacttgtaggttgcattttaaaagttacctattcgttcagtcacaattttacatctgtttttgtctccaagtggctttcctgatgtctagcacattggacagttccttagggaaaattgcagaaagggaacacaagctagcaatctgttctaggattaggcagtagaaattgggtagagctgccccaccctcctgccatagatatgtgaatgcctagtgcaaagaccttgccgctttggataaatcatgtcgccattcttgcttacggtagcattcttaggagcattctgtaaatagaggttattctaagtgcctgttttgtgcagcccagaatatcatacctgtagttaggaattcccgtgttattgccccttctataagtcaaaggtgagtaagtcaaatattcaaccaaaatatctcctttgttttcagggataaattttattgctcctctaacatagggaatctggggccagatattcatgcggctcaaaaagtctgtgtcaaaaagcccaaaatcttatgttaacttttattgtcttaaggaaagtgataaacttagttgtgacttgttatgtaggagaaaagtactaaaaatattattctcaaagcatgtataacttgtttatattttattggtgtagaaatgactagaatttaactgaatgtgaaattctagggaatattcaaatggcagctctatttatattccagggtgtacctcttgcaacagtaaaactttcttaagatgttttaagaaatgctccatcactagataccttttgaagcactgaaacatttgaacaaaaccaatcatactaagaagaaaaatgcatttatcttggttcttggtgatccataagcataataaaaatctaaccgatgaaaacccagagcccctgtactgctacttttgaggcatttacgaacctagccaacctcattgtgccatttttataatttgactcagacgatcttatttgtagacgaattagtacctctgaattagaacacataatatcgtggaagtgtcacagttggaaacgtcttaagagagttttatcatctttctgggtttactaaaagtaaaatagcattttctattttcattatttttaatactgcatcattaaaaataattagggtttatttcaattgacaagttctcttagctctatgtagcaagctgggtttgatgaggaaattattatccataacacatcaccatataaaattgtcttctgaaatgacagcactttttcttatttttttttgatattataagtctagaattttataatttttctagctagctgtagtataccctatttcttaatcattagtcccattttaaaaagtaatctctttagcatagaaagtcatatgagcacaatttgaaatgctttagccttagaaacatatcctggcatgttttggtaacacatagtattaatatttggtgcaacagcttgtacatagttcgtattctgacattaccatgactttaagaggtccccgcatgcttatttcatgatctttctaaactctgaggtacatcagcacatttcctcgcaacatccattcacacgcagcacccttccctcccctcatctgtacacatcgaagcaattggcagagagcacatttccccctgagcgagcagtattgtgaattttatcttctcttccagaaatcagttcgtcttcgttgcagcagatgaaatttcttgtaacacctctgcaggtaacaaacgttgctacttcttgatgcatccatccaagtctcagtatccttttttttttttttttttcttcttcacatgctgcagttggtcactctagaaagtttagttaagaaaaaaaaaaaagatcttatatctttggagtacagctgaagccttgaggctctgccatataagacgacattaggcattttgctaactttgatgttttatttctggttttaataatacatggtccagaaaagtaagagtatgttgaatgaatccacaagaaaatcttacagtataatcagtgctcttatggtaaaatagggaacaggaagattaggtacacagacgtatgacttccatgttttttgacgtgttatgtctgggttcatagagactgatgtgtgaattatttgggatctttatggaatattagaggctgtaaaagactgaatctataaagcttagaggcattcgagaatataattatctctgtcttataagaaggggatcttcattctattagccaaagatcctctatttcctttcttataaaacatctctcaagtagcaggacttagagagaccaggtcttttggttttgaaaccaggacattggcaaatggaaattgcatagctgcatgatacgtccatcaaaataacacctgtcttttttctttgatgtggttcagaacagttaaatttgtactttgattagtatggagttaattaaatgccaagataggtgaatgccttaacactagatttccttctttttccttttgtcgtttttaagcctaaactatgaccaaaacaatcactaggaagtcttgccaatgtgttgctttcagcctgcgagggaggacgttacaacttatcactacataactgagcatcccatgaccttcagacacatacattaaactgaaccttacaaataaacactcatctgttaccttttatcaatgctgcagtaaaaaaaggcttatgtgccaatgtttcactccctatttactgcctttggtgagaatgaatgaatgaaaggaaggacagagagctaggaacatgcacccaactatctctgttctaaaaggcagggtcagttttatttatatggtcagcctcaaccttcataacgggttaaagtcttacctggtgagttcaagaggtatgcatgatgcatgctgacattttaaaacaatggtatactctttctataaaacctctttgctgatggtcctgcaatttccctcttaacccctagactcgtatctctgcttctcattgtgagaggtggcgacatccttaacactttactaatgcccagtgctaggtgcaatggttaattgaattgctgggagtggcagggaatgttcctgcaatacaaaagttgtttaacattttcagagccttagtggaatggagcatgaaacaaaaggggagaccgcttggaatgggaggtaggggtggggaataatgttaatttaaaatgttcataggcctcatgtatagatgcctcagtgcactagagcttctgccttctgttaacccctgtgcatgttccagtatgttaggttatatttggacatcttagatcaaacatgaaaaagatattgattttgccccgtgacttaaaccctgccttataagcaagtgatccacacacaatatttctaagaaaggcgacagaaaatgaaagtttgcatgcgtgtggtgagtgtttccatctacctaatctagatggctgctcagtaaattcttaatgaattgctattgatcacatttcagattgagagagatatccctagtcctttgatggccattttaatattatgttgcatgcttcataaggttccgtttgaactctgaattttgaatgaagcatgaaaaaggagacacccatatccatcaaatgtcagattatctcccagcaagttcaccttgctcatagagcgaaaatgaaaaatcaaaactgctcagtcaacaaaggttgtaactcgtggtttcagtgaaagccttctagggcatcatctcctacatgctgaaaaaacctgctttgggaggccaaggtgggtggatcatgagggtcaggagtctaagaccagcctggccaacatggtgaaaccccatctctactaaaaatacaaaaattagccgggtgtggtggcacatgcctgtaatcccaactactcaggagactgaggcagagaattgcttgaactggggaggcggaggttgcagtgagcagagactgcgccactgcactccggcctggacgacagagcaagcctccatcaaaaaaaaaaaaaaaaaaaaaaatcctgctgtgcccactacccacattctaaacagcactactgtaatgagctctcacctccttataaaaacatttattagagcaggtgtattgaatcctgctatctactggatatcagagtttgacaaaagacaagttctctatttttaaatggagaaaaaaaaatcaacatgcttaaaatctcagtgtggggtttgatggatgttataactgaaattcttataaagaggtgctattgtcacattgatgcccatggtggatgggctaagcataggcagccatcaggggcttcgggtggagatagtgagatgaaaatcattaagcagtagaacagcagcatttcaggatttgttcttcacgtttcccaaagaaaagcaatgccttttacgtgggtcttgtgtcgagagtgccaacacatctggtctgctttttctagccacatggaataggcatttttcattaacatttgtggtctgtgagactaatttacaaggatatctattttcttacctaggagtttcaacaatgctattagttgtgttgttttgttttggtttttcccaaagaatgtgtgctctgttgggtatcacttgggactaggcttttataacagggcaggacacctcctaatgcatccagcttggacaactgagtaggtcctcattcagtaacatcaagaacctttgatgagttggattcttcaatagatggtgaaaagggagtaaatgattttcccttcttagacgggaggtctccgtctgtgattcattaggaattttccagggtgggctagtgattgtagtagttgcagaagaagggtctggtatgagaatggaggttgaaaagcaagttacttaatcagtgactagaaattcattttagtcgattaatatctctagtcctttgtgggtgtcaggaactgttctaagccctggggacatagcattaaatgagtcaggagaaggtctcatcaaaagaccttcatggtatgggagaacagatcccaaagcacgtatatgaataagcagataatatatatgcatagtaagttatgtacttactgtaatgaatcaaaaagcaggggaggggatggaaagtaaggtgcaatgctattttagactcagccatcagagaaggcctgtctgagggggtaacatttgagcagggatctaaatataaagtgaacgtgtgacccatgaaacatacagcaggtgcagagaccctgtggttgagacatacttgaggtgtccaggagtaagacatccagtgtggcccacggatatgagtacaggtgagtttaatagataacatctaggaggtagacaggggtcagaggaagttaggacttggaggctgcagaacatatttgggattttaacagtgatgcagaggcattggagggagggttgtaatctgactttaatgatcagataagactgctttgtggagaccaaactgccaaagaacagaagaaacagcaccgaagggcaatgggggggcccttacagctgtccagagaggggtgacaatggcttgggttagtggggtggctgtgggtgagaagtggtcatctttaagctgtattttgatgggagaacaaacaggacatactggcagattagaagtgtacaagctcgagtctgttaaatgtccactccccactcttgttctaagggtctatcagttaattccatggagcaccaaggctttaatccctgaggaaagcaaaccctttatccctgtagtaattgtcccttgttgagggctttgctgaactctccaaggtgtaatagtaacttactgtcatttattgagcaaattatgtgtgctagtatgatatacatacatgcatgtatatgtataatgcatgcatatgtatgataaactatatatgcatgtatatatgtatcacagtagttcaacgaggtgttatccccattttggaaagtgaaaaaaacatacactcaggtccagaaacatttagtagcttgcccagtcacactggagtccatctgatgccaaaacccttcccctgggtcacactgcctccacacacacctttttcttcacccttggaactttggccttctcactccagatggaattctaccttccccagtatgctatcttgctcctatgaaactagtattttgagtcggatgacaaagttgttactatttggaagagacccaagggcactgtatgattctttagcagttgttccactggaattttatttaacttggcttgtccccttcaggcagcaggcatatgtttagttccgtgtgctgggagtactggtgtagttgtggggacagagggagcagatgtcaggtcaggaagcatgttgcgtattagggaagagagggttaaacaggccaagtgtgttctaggttaattcaccagacgtctttttgctgaaagttagtggctgaaaaacaattaacaatatgctagtccctgaaaaccccagacaggttgaaacagttgttttagacacagagtccaagagggtgtgtgtgtgtgtgtgtgtgtgtgtgtgtgtataaagggggtaggtggaggctgggactcactagcaggaagatatgccccttccaccatgccaggacccaccatgcattcccttagcaaatctggggacatgttttcatctcagttcctgatgagtatgggacacaaccatgtggggtgagggtagggtctgcaagaaagccttgagcaaatgaacaatctgcaaaagctgttgaaactgttctctgtggggcaggttgctacccaagttaccaattagaagcaagttcaggggtacaaggaggtgtcaccagcgcctttcatttttctatccccacttctcaacctacacatgctgccagctacattaaaactttaggtaatatttaatatttagaagaagtttcccaattggccattcctctaactgatccttcagcaagtctcatctaattgtcttttctgcattttagtgatttgattattcagcaaagttgtcatgcagtaaattgatttgtggctaattggtccatttccaataaagtgtgatatgtattataatagggaaagtacagggagctaaggggccatataagcaaaggaacttaggaaacatactcccacttattgagaaccttctgtatatgaggcatagtctcaggcttgctgcatgcaataacaataccctataaagtgtgtgcaatcaatttgtgaaaattaaagatgtctagatagtctgaattagcctaagtgggaaagtgctgtatccatgcatgcagaattttaaaaaatggaatggtggttatcaaattctagaagaatgcaccaaagtcacctggagaacttgttacaaatgcagagcctgttttgtcgccttcccctgcccctgagattctgattcataagtccggagagggagcctggaaatctgcattctaacaagttgccccagataattgtaatagaaaagacctcacaccttgggacacactaactgatcaatcagggaccttttctctttgagatagggtctctgtcatccaggctggagagttcagtgcaatagcctgatcttagcttcctgtaatcctggacctcctgggatctagcgatcctcccacttcaccctccctagtagctgggagtacaggcaggtgctaccacacccagctgatatcttaattttttgaagaaatggggtcttgttctattgcccaggctgatctcaaactcctggcctcaagccatcctgcccctttggcctaccaaagtcctgcgagtacaggcacgggcccaccacacccagccaacgttttttgtttcaatggtaaaaagagcacacaataggacttgctaaagttgtgttcacatgtggctgtggagcccttgagatgtggccagtccacaccaggatgagttgtaagtaaaaaatgcatgctggatttccaaaacttagtacaaaaatgatgtaaaatatatcaataattgtgagttacacattgtagtgatgacagtttgaatattctggagaaaataaaaatgagttcaccttttttttttactttttaaaatgttactgtaaaatttaaaatgacatatgtcttgcatgtgtggcttttattatgtttctctcaatcccattttagaaccacatttttcatttggctcaaatgaatattgaaagagtttgtgtgtccccaagaactggtcatttggaggtgggggatgttcaccaggagttaaaatgttgtgacagataatctggacattgtcagtgtcttggtattggattttaacgttgcctcctggtgctaggtgggtgtgttggtgctgtagagggacattccttggggttcagggcccagaacctccctacttctcaacctgcttgttttgtcttaatctttgatctgcttgctttgaggatgggagatgccagtacataagactttggatcatcaatccaattcaggggtagctctgacacatgtacccctggggctttaccgggaagctcactgatcccacataaaatagacgagaggcaatagctgcagtcctctcagtcttaataactgtcacttgtttagtccttaactagtaatcataaccctcctctcaccctcactgtagccttgtacgatgaggatgcaccattatcatctccatttatagatggtataaccaactcaaagagaagaactttgagatagcttagcaagaagtaacagtcagtgtttgactctagaaattctgactgagggatccccagctgctgttcaaccctgcttcatggaagggtattgaaaatctcataagggatacaatttgtttttcctcctatggggtaaagtatagctggggtgccatggtgatttcaaagcacaataaaaattcttagtgattttggtagagcaggagtagacaaacaaaggagaaatgaaatttctaagagaaggatggccttgagctctgcattaaagagaatgtgcctacagctccttttttagaggaggtattctagggcaggagaatttcatcaccaaaagtgggacttacttactgtgtcttctctactccgagagtggctgctattctgctttccctcaaatctgctgttgggtttcagaataggaagaggttttcagaataggaagaggttttgaatggcattggtgggctagagaaaagatgatgtgatctgatttgccatgggtaaatggtctgagtcttttagatgccacagtgttggatttgtgtacgtattatgtatgcatagttctgatgtatgacaggtatccatgggcaaaaaaaagcaagttctgtggcttctcatgtagggtctaaaaagctcagatgtgttccctcctacttctcaggggaggcagggaaatcacgaggttgaaaaatgtgctaagtgatttctgaagttaagcgctttaaagacaagctaaggaagtcagcagcaatgaaactcaaacagagccaagtagagatgactccatgttatcttggagcatttcttccacttctagttttatcatttttggagactttgctgcatttttagtcattttgtaggtcaggggtccccaactggacacacagcaggtggtgagcggggtggggggtgagcaacgcttcctgtttgcagccgccccctctcactcacattcctgcctgagctccacctcctgtctgaccagtggcagcattagattctcatgggagcaccaaccctactgtaaactgtgcatgtgaggcatctaggttgcacactccttttgagaatctaatgcctgatgatctgaagtggaacagttttttttcctgaaactattctccacctccctggtctgtggaaaaactgtcttctacaaaactggtccctggtgccaagaaggccagggacttctcctctaggtgtttagggactggtttagttcctccaacttcagtatcttgagaagctttgaggataagtgagcttggtcatccctatggtcaataaatgtataagtcattgctcaaattaaaactaggagaaggctatagtaaccacagaggagtatttccctaaattcactaactgaccaacagatctgaagtccagaactcagttgacccttgtagagtgaaagtgaacaggaacatttcctagataaaccattgctttctgaatttcccaatacatccaagtagttatgttaatgctttcaggagggtttctccctgttgcagcaaaccagggtgcatggcctgaggttctggaaaccctctcaaatctttctgtagggcagaggtggggtggttggcacctgttgtctctccatgtacctgcatagtgcactgagataacttgtcctttccttgaatggctcttctcctgcaagattaaaatcttggccataattaccccaacattttctcaaatggatgcgcactgggattagcccagaccttacaacctgggattctgcgatttgaaaatggagattttggttgtgtggtaaatatttattggcatgaagataagagactgatcatttcagagatatactgaggtgtcctaagctcggaatttttgaaagatcttctgtgaagtcccatattctgggctacatttctttgtcctttgaagtgagcttttgtctccattctgaccccacagaatccccaagaagctgaggggacctctctgcagttgcagaattgccaagagatttgtcagaagccttcagcctctttcagtaggactgtgagatcttactgttttgctgcattttcatttagtgacgagtatgggatggttgagttggaaaacataaatgcccataacagtttatgattgacaacggattcatttatttctagttggatgagagaaggaagtaaagcagtagctggggcagtgctgcagaactcagaagccatgcgccctccccttctggtcttgttctttcttttcctggccaatattggctgtgactcctttccagcccctgagaattgctgaaagccgagcattttgtccaaacacagaacacttggtctggaatgtatgttccagatgcagttcctccggatgggcaaaagcaacaactcattggtaatgataccagcaacaatgcaaaccaaaggattgtcttcaacacatcatttatttttcatttggaaaagtcctcaaaccccaaaaatgagggcaatgaaataggatgaatatctgagtgggatgagaatcacttcttcctgggtgcaggttaccttctgatgtcccccttcttacctggtgccccagagcaccccaaccaggggggtagacagcagaactgctaaatctcatttgaccctatacagggaagtgaaagagaacatccctttagctagaccatggctctctaaagagcatgcttttagaaccactgaaccacagttggtgccctgttgctatgctgtacggtaagtgtgcgacttgcatggattcatttttccaaatacttaagactatgccttagatataaggataaaggaggcactgtagtccctaattgcattgcagagacccgggccattcattgatccctggtgagacatcccattttgaatgcatactctgcagcccttctctgtgttgggaggggtacaagcccatgcattttcttgctgccatttggctgtttaggatgtctttgctaccttctgaacttcatctgagagctgagcagatttcactcatctttctgctccacaggattcacccagctatctctggggtgagaagcatggggagatgatactaatggaagaataaaaagttcccagggcataaacgctcctcatcaaaatagggagtaaaatatagtgaaattaattagtgttcttactgtggccctataagaaaattatgttaaaaccctggtgtggagtaccaacatgggcccattgtatctcattagcatccagcttgtttcaagtaggtgtacatagtacttcttgctaacgtgtctcagtagagttgataaagcactttaacaaacacgggtttatattcccattcaagaggctgcatacttattcattttgctccaacacaaccttaagttcaagtaagtatatccatttgaactacatctgtaactcataaattagatctcaactccaaaagcatctgtaatttgatcggtagagctgcatgtgattatattagaatggaatttttcaattgcctctgcagaccaaaagtctgggcaaggagggagagattggtttgtgaaatacaatctaagaagccatgtatcataatctcctctatctgtaggtggcttaatatttacctggctttcttgaatgcaccttgagttaggtagggctcagtcagaaaactactgctttacaaatgaggaagatgaggctcagagagcatgctctgtccaagtcatgagagcaaggacatcataaaagcagaactcaaacctggatctttttgccccaagtcctgaatctccaagccctcgggttgcttcccagttttaacttgttgctaaaggtcaaaaagatgaggtctcatgatggttgcaagccatggtgaattagccaggaaagcagtcctcttttatatctttgtttagtttttccctgaaggcttttgatgagttttatggcaacttggccagtgttttgcaaactcacagaaatgatgtaaaaagtgtacactatttctagagtccccagaaagttttcttctgtcttgaagcatcctgaatgtgtctgggagcagctgacccagagtcttcaaaaagcgtatctgaatgggatcataattacaggcatgagtgtctctcccaggccccatttctctctttactcctttgtcttgctgcctcctctctacctgcactgttctagacagtggggatgcaatggcagacaaaatagacactgccccagcctccatggagttctcgttccaggagggtgaaaggtaaatgatcaggtggagtgggaaataagattattagagttgctatacaacatgaaggggtagggatgaagttggaaagtgcccttaaaaataagagcagtcaggctgggtgtggtagctcatgtttgtaatcctagcactttgggaggccaaggcaggcagatcacttgaggttatgagtttgagaccagcctgggcaacatggtgaaatgttgtctacaaaatgcaaaatttagccacgtatggtgatgggcgcctgtaatcccagcaactggggaggctgaggcagaatcgcttgaacccagaaggcagaggttagagtgagccgagatcatgtcactgcactccagccgaggtgacagagcaagactctgtctcaaaagaaaaaaaaaaaaaaaaggcagagagccagagaaagaagcatctcttcatctctctagggaagggacatttgatttgaaacataaaagatgaaagtcaggtggagggtgagcaagtgccaagactaagcagagaatggatttgcatgtgtgcaggaacgatcaagaaagcctgtgtgggccgggcatggtggctcatgcgtgtaatcccagcactttgggaggccgaggcaggaggatcacgaggtcaggagatcaaaaccatcgtggctaacacagtgaagccccatatctactaaaaatagaaaaattagctgggtgtggtggcaggtacctgtagtcccagctattcgggaggctgaggcaggagaatggcatgaacttgagggacggagcttgcagtgagccaagattgtgccactgcactccagccttagcaacagagcaagaccaactcaaaaaaatattaaattttttaaaaatcctatgtgcctggagcacagtaaccaagggaaggaagatgaagattgaaagagggacagaggcagcttattcaagtttggattttattctaggatcaatggaaaactattgaagggttttaagcggggagtcataggattagatttatatttaagtggagagatggacagacttgagagatttgatacatgtaaatagctgctggtttgaaggagcaagagttgaaaaaatgagacaagatttatggctgttgagttggtgttgatgaactagtggcatatattagtgtagtcatcatgtgcatggagtaaagtggacacattgaagatttcttccgaaattactgatggatgggaagtgggcacatggagatcatcatgatctgactgcactactgcccactttggccagggatgcatggtgtggaggatgaccatatagctggtcgtgtcctaacatggcgaccgtaagacctcttcccatcattcctgtggacatcctgggtattgctgtgctctgtctccgggctgtgcttagccagctctgaggacatcagattgctgacgtgcttggcatatctgctgcaaacgtagcactcaagtccacatcttccccaataaccttgtgactaaattgtagtgtcacacaagggcgtgttcagaaattagcatttgaaaagaagcctccttgctttcagtttgagctgacatgatctcttttcctctggggaaatgaaatttattaatcataataaaaccattggattctgaaggtagaggtcaccctgaagagaaaaggaggcagctcatttctgaggagtagttcaatgctgctgtattttccttctgccttggaagagaatactgccaaattgttaccttgggttttccacaaaggttgaaactatgcccagcgttatagaatttaccactgaagtatgcagtaggaaaaggtgggagctacgcttttattaaatacattcaaattgcccatatagtgtctccccagaagaggaaattattgccacagtaaaaccatttccccaatttttaaaataatatatctgaatttgcatcttttcacatttgttttgaggtaacaccttgccataacatcacttaacaaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaagaatgaaaggcaagagggagatgactgtcagtttcactgacagattcacctcagaagagaggcatcccttcaggtccttgtttgaggatcaggagaatcctcttgaagctgaaagcctcatctagattatttgcactcatcaagtgccctttgacacaggcagatgggcttgagagttggaagatgcccagtgcaaacctggtataatcaattgttttattccacctagggtctaacttggagtctgagaaggtccatcatcacgctttcttcaccttctcagactccatggtgtgaggtggtcaaacatgtattggattggtatcacttatctaccaaccatgagaaagcttggaaggaaaatggggggaaaacaggaaaggagagggaaaaggtacgtgcaaattgggctctaagggatgagagacgagctgaaggttgataatacagacaaaccatttcttccaccagccttgttccttcattcaggaaatggtcaaagaatcaaaaaacgatgtcgatcccagtgagtgtctgatgcattcatgccgagctgctgtgaatgttggttgctaacagtacagctgttcccttctccagaaaattgccccatgtcagaggaagccactttaactcaatggtgcatcactcactcctcaggaaagcccacagctaatgccgaaaacttatgtaggcattaaaaagccaacccacttgcctctaggtggaacctgctgtagcatgaaacccataggatcaggtcgcagatattcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaaaagttaacttccagatatttagtaggcattcagcacgtttggtttccatctcttctccatttttatcctaaagcctataccagaagccatggcaggtagtaggatggtagagagaaaaacacaaagatgagtaaatgtcattaagatttgttgtttcaaatgcctcccccttcccagaacctggccatggattaatgtgacagaagttctggaataataggatcaaaaccaaatcagtctgattgaatgggaatgggaatgggggtcccacagaccctttaaggctgcttccattcaaatatacttgttcctttccattctaagatgctggacactaacttcagacaggttcacttcaccctttctgattcaccctatttcacttgaatggtgacagctgaatcaggagaaaaaggcactctcttgagaattaaaataccctctgtgggtgctgggcttaatacttgaagttgtttctttcttacctacctcagtctctaaggcagctacttgagcagtgtagaaacagtattatggggggaggcagggaaaagcatatgtaagtacgtgtgtatatatgtatttatctgtcaaacatagcaatagcaaccatgttaaatgcacaaaaaatgtatcatgtacagatgaactcttcttatactacacagcagagtagaatttgcttctcactggaagatgagtagggcccctgcatactgtcttggtattttggattttatgattgttattgttttgtaattgcatactgtggatcaatcttcacctctattttcctttcagttacggacgagtttatgctgccgacccctaccaccacgcacttgctccagcccccacctacggcgttggtgccatggtgagtacaagtttctccttgtcctcactttctcctgcctcccttccctttccccagctgggacctcagtacgggttgacgtcctctcacttcccgttaattgaatttgtctcttgtgctaacagcagctaaaatgccacattaatcctcccagtaaacttgataaatgtcttaatttcttggcaatgtagtgcatgtaagttattatatttctaattttgcaagtctcacctagcagagcacttaccttaatggaataattagtcattttgataattaaatccatcactaacagaatgcagtgtcaatgcagaacttttttttttctttttttttccctcccttgctgctcattcacatagccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 430 - DNA, 48025 bp, Homo sapiens
cacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcctccagcccctgggggccggcgttcctgggctccgcccccgtccccgcccctcgaccgccgctgctccgcggggactcggggagctcgaaggaactctgggaaagtttcccgctccgccccggcccgagcggaagcgcggatggggcgtggcccggtagctgtggccgcgcccccaccgattgcgcatttcgattggcgttagtggccgtccgtcagcacgccccctccggtctcgcgtcccgattggtcgcgggggccgtcagtccggctccggcggcgggcgcttcccggggctgcggcggggcggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 431 - DNA, 47394 bp, Homo sapiens
cggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 432 - DNA, 43211 bp, Homo sapiens
gctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 433 - DNA, 47394 bp, Homo sapiens; identical to SEQ ID NO: 431

SEQ ID NO: 434 - DNA, 145323 bp, Homo sapiens
agagtattgcaacactttattaagagtattggctttgaatcagtagctgaagtaacaattgcatgaagccagattaggtgcactgcataatacccatactcgatttattgacattacttagcaatttactggacaaaagtcaaacttttttgttttttattaagcacattccacagtacaaagctgtcatgaataatatctgtacaatttaacagtttcaatagctgttcagacacaaatttatttcaaacagataattggcaaacataattaattacaagttagaattagactatcccagtgctttaaaacattaatatagcagtaatttacatttgctcagttatggttagcaaaataaagtccagagtatggctgggaattactattataatcccagaaagtcagaactccttgggtgccaaagtcccctgctataatttagtaggcacaattcaaaggttgtctgcatattcaaaggccatcatctcccaaggaacgaggggaacttctatattaaacatgcaaaaacaacaaaaaatccattcattcattcagaattgcctcctcccctgccccctcccttccccctgggctttcctaaccagtttgatattgaagctgtaggatgaaaagtggtcaaagctaaatcactttcacaaccaccatcaagcttacaacatccaccttatgaatggaggtttattgtttacactttgagactcaacctctcaaaaacataaattaatttagtaacatgggaaggaaggattttatttttaaaagaaaaactaaaaaagcaaagccaactcaataaacaaatcacatacacacacactgatccccacaccgttctcaatgcaaaggacaaatcagagcccagggccttccctttagtagtagagtgtgcttccacgggaagaggtttactttataggaggctgtttattggtcctttaaaatgttattgacattccttgatctttggaaacaatggcgaagggcaaatcaaacctaatattgaataagggagaaggagtgccaattggatgccaacgtcctttccatgcactgtcagggcaacagtgccatttacacatttgggctgtgtcgtagggaggacttgggagctttgagaacctgctggggccacagcagcagctgacaccagagatgactggggtggcattcatgggcttgaggcttcactccacttcagagcacccacccctcagcatgggcctctgaaccagcctgacctgccctgcaggctccaacacaccagcaggccctgccagaaccttggcaaggccaggatgcatgaattccagagccaagacagcccgtcaacagggccttcttatttccccttcccagggccacgactgcacagaataatgatttttgacagcgaagccaaatgaatactatgggaggtgaccacttgtactcaggagtacttatgagaaaaagaataagaacaaaaaatgtttaaggtacctctctattgtataatatatactccacaacaaataaaacattttggtgttaaaccttagaaattacattttaaaacaagattctcattaaaaacacacacaaaccacacacacgcaatgacaacaacaaaataaaaacactgtatgaatactgcaggaagggttctaggtaatccacatcaacccaggtatcaggttcttgagcccagcccatggctaagtgcgaacacactctgtattagtgtctcaagcacagggggccctgactccagcaactttgaggttaaactgttatgtacattatatctacatgcgaatacagtattttaaattaggaggcaagcacacgtataaaggtgttactctaccaaatatcaggagatggttgggggacagagaacagttaataaaagaaagagctatattacctgttggtagataatataactgacttatagttctttaaattaaaagaaattggtacagaaaggaagtataatcccaaaaatattactaaaacaatccagagaaaattttccactgtccaacatgttcctaatacaacaagtcagaattcataatgacttggacggtcaaaaggagaatgctaacttttgaaaatgaaagccctggacattctgggtaggtgtttggcacccaaaatttcactgaagaagaatgctgtttcttaatatcaaaccaaagtgcaaagcaatataaattagaggccaagtcttctcttgacggtcgatttacttctgtaaaacagattctatgttccttttctatgaacaatttacatttgaaacattagattttttcactgatgagggaaggaaacgggcttctgttctacttgaagccggggaagctaaggtctccttctcaaaggagagccggaatcagaggtgagaaatgtcggtacttgaagagttaggctgctttgcatctacccagcgtctagaaccaattccagcttcataactcagctgtgaacgaactcccttaggcatttggtagccacgtagccagtagttcaagactagaaaaccctgaggaaagaaaaacagaagcaaagggagtgtgggtgaacattccgtttagatgagaatacacacactccactccaccccctgcacacagctacatgcaaaacttattagcattaacagcagaagctgtaagttgttctgagtgtactacataccaggtatcacatttatttcaacctcacaacaatcctgtgaggaagaaactattatgacacctgcttcacaaataagagaactaaggctcagaaaggctaagtgtttggttcaaagagtcaacaagtgacagagaggggattcaaggagagggctgaccctataacctatcactctctcagtactgctctgaaaaagtacacatataacaaaagatgcttcacattcgattttatatttagcataatcttttatgacattcagaacctacaagaggccagtctcacatcctcacgagagccctcatcgatcacaaggaaacaaaaatatgcaaaaattagcctttctaaaatagaatgctagtaatcagaaattacttcctttttaataagtaaatcattggtaaaacaacaacagtatgggggaaaggccactgaatgttccataattttttgactatggctttgagtctgaaacacattttaatcacaatttctacattcatcatgtatgtaaatatgtacacacacacacaaaaaaacaatattcatgagaatactgatattcacaatatttatcatttttacatacaatgcaggctgacattttctattctaaatcaaaataaagtcaaaacccactcagatactgtcacaataagtgatgcactaaaccactggccagaaagtctaaagtcaccttaggtggcaaaaaaaaaaaaaaaagcaagagagactttttaaagcttgaatgctttttttaaaaggtgattttcccagaaagttgtcaatttacacaaagatcaagaatcttaagtcttctcaatgaatttaagattcaatttcatttgctactgttttcccattaaggatatttaagggaacctgaattatttcaaaaacattaatgccccaggaccagaagtggacactctcaaatgctgctgaggggagcataaactgactgaactcttctggagggcaaaatgacctacatacgcacatgtaccctagaacttaaagtataattaaaaaaaaaaaaaaagtcttcaaacgtgataccttttaacccagaccctccagacatttccagaatccctccaaagatgataaagggttggacaaatattaggttaaaagaatgatcatagcattgttttttataatcactaaaaactgggggttggggaggataaatatgtaacaacagagcatatccaaacaatctaatataatttggcaattaggaataatttggacaaatacattactaacatgcaagcatttcacaataaagaagaaaaacacatttgaaaatgtacagttataaagcgtcattttaaaaagcctgaaaggatctataaaaaggagttagtggtaaaccacgagcaggagtttactttcttcttttggcttatctactttttcaaatttcctaataacgatcttatattgtcttgtagtaagaaaaaacaataaattttgagctactgaatatataatacaacatacagctcttagatgttactaatttttttaaaaacgactccgcagatagatctactgctgcatttgctgacatggagagactctcacctgatattttacgggtgagtattttactgcaaggttaaatcatcattagggtagtgtttcttattatgcataaatcttatggtatcacatggctataatttttttcatgttacaataaatgaaaagcatttggggccgcacgcggtggctcactcctttattcccagcacttcaggagtctgaggcgggcagatcaattgaggtcaggagttcgagaccagcctggccaacatggtgaaaccccatctccattaaaaatacaaaaatcagctgggtgtgatggcacatgcctgtagccccagctacttgcaaggctgaggcaagaggatcacccgagcctgggaggcggaggttgcagtgagccaaaattgcaccactgcactccagcctgggtgacagagcaagacattgtctcaaagggaaaaaaaaaaaaaaattagaaaagagcagtaaaatctataaagttgactgccaaggttgttaaaagtaataaaattgaagagacaaacacatttgtggtctcactgcttgtgctgggatacagggaacctccagcttaagcagataagatttttccattgacttataattgatcacaactaggcagttgttctgaggtttccaaaaaaggtaggtaggagggagggcctggaggaagtaacacaagtttcctttctaccacagccaataagaaacagcattggtgatcactgcttcatctctcaaccaaaggaatcttgttcagggcacttttaggtaatatatagatgttgtcagttcatctattgtaatacaccagaaaaagaaaaccataatatggatgtcttgaattttgccatatgcctctttaagcagtttttacttgggtccattcctccttccctatattttcttaggcttattgggaggggaggtcagggggaggagcaatcactcaagagatccttgtctccttcctctgtaattcctattttaaagctccattcaataattacagtaattctgccacgtggatttttcaactgacttatgaagcatctatccagaaagaaagcagcagggcagaagattatgatcaggaacagtctgaacacactcgagacccataatagcaaataggtaagtggcttacaggtcactcctgcaaggcagacataaccaaccacaaccagtcctttggggtccacgtggggtcccagaatccttccaaaggcaacacacccaccagtcactactgaccaaactgagttggcatgaagaaaacacttatttgccattcctgatgtagacccttggtttaccgctaatagatggagcaggggcaagaccagaagtcagccaactttttctgaaagggccatatggtaaatatttcagatgttgtaggccataaggtctctgttgcaactactaagctctgccactgaagcacaaaaacagccacagacaatacataaaggaatgagcatggctgtgtagcacaaatgtttatttatgaacactgcaatttaaatttcatttaattactgcatgtcatgaaaaaaattcttttaatttttttaagcatttaaaaatgtaaaaactattcttagcctgtggagacaggaaaaaaaaaaacttaatggataagcagagactaattaaaaaaaaaaaaaacgggtagtgagttaattttggcccctggttatatagtttcttgacctctaggtaagacaaacttcctggtggagttctatttattggatcttggaatcttgatgaaagagtatctgaaaagatggtaacttagtgaataggtaccaagagttctcaatctctccatcaaaaaaattcctaattctgcacatggactttcttatacttttgaaattcaatgaacaggaaaatatgtaatgataaaagaccactaagaattaagtaacgattttaaataaatacaaattttattaatcacaacagtctttatatacatatatccatagtagtatgtttatatgtaaacatttattcaatctacaaagtttaatgtgtatagaattcactggccctcagcagaacacagagttgtcaatactgttcctaagtcatcagttcctaggacacagccaagtaagacttctcatcttccagactgaacacgcttagtaataatcaaaacattctgtcatcaatggttataatgactttcagtgttcctgtaaccagaggaaaggactttgcttctcagtgtatctgttgtgtttcatggaagcagaataggttttaggggtctctcaacagatactcttctctgattcatccttgaggaaaggatggtggtgggtggattgtggtagtggggaagagagggattttgaatgttttgtcagatggtgattttttttttttttttaataaaagaactgaaggacaggaaagaaagagaaaaagaagattcttgtaccccaaaataaaattcaagacattttactggtgttaaattgattatgacctaagaaatcatttaggaacagtttttaaaaacaggaaccatgttcatcatctgccaagatgaaaacccacacaataggcaggattccaactcaagccttgtatggatgtgactataaagatccagccttacacttgaactctgcaaaagttgacacgtctaagagagaccttggttcacacatcaccaaggaacccaaatcacaaaatttccccaaagggaaggtgaattcaatcagcaaaattggaaggggagaggatagtactcacctgaaacgggtgaaagtgcagactgttatctagagatgtaagtgtatgttctggagggagaacgggtctcattctgggcactgggaggcacatttaagaaatcccaaatcaaaatagtgtcatcatgggagctgctgatgatctgaaactcatcaaactggagccgaaacacacgtccagaatgttcctatgaaatacaaaacttcatgaataaaatgagatctttacagcccctgatatctcacaatgagaaactgggcagaagatgaaaatgcagccacttaaacagacttcctaaacgactgtacagagctcactgaactgtgtccttcatcccaagaacaaatgttcttctttcttttcctgctaggccttttctttcattaaactttgtatcttagactctagtctaccaatatttcaaagatcatctcaaaaagggccttataaaagtaaacaacaatacataatacccattcttgatacactctaaaaatccactggaaaacctagaaccagaaagacagtttgttttaacatgaccaggatctacctcaaattgctgccagcatcaaaattcatggtgaaataataatataagagttcccattaaaatcaagaagacagttctgcatcttctagtaaatgcaagaagtgaagaaacagaaataaaactactaaaatcttttttaaatctaccaatatttccaaatgactatctcttcaaaaatataacagtacttataaatggtataaaaatttatatatagtataaaaatgtgctgttattaaaacataaccacaaatagccatattaagaaatcttccaaacctacaagaaggaaatattgcttgccctatgaggaaaccagtccacctacaaatcaggaagcctgccttcatatcttaagctgcattatgtctccccttaggaaagtgctcacagtaatgtaaacatcaaatattctctggttttggctaaacaaaatgaagactgaaattctctgaaggcatcttgtgagacacacaagcgttcctgtgatacacctagacaggactatctgcaaatggtcatcctccagcacagggaaccaattcccgtctcaagagatcacataccaccaatgtgcgcaaacacaatgtgcttgctggggctcgagggtcaagagcagcttgcaagtcccaaactttaattttcctagaaaggaaaatgagatgtgattagtggaaaagtgaacaatttatatgctgtcaaacatttccttgaaaaaaagtagtgcatctgaactgcctatttataaaagctaatggggaacatgcttatgtttttacaaatcatctgaaccaattacacttgattttggaaaaattaagaacctacacattctcagaattgctgaaattttaaagaaatattattttaagggagataagaaaacaacttcaggttatctaaattcagttccggacttgataacctatgtcaccaaattcattcatcaggggactctctagggctgagtaggtgctgctgacagaagctagggctctgtgtgaaattccaaggatacctttctccaaattaagcaaatgctggaagttagtaataggagtacaaacagaccaactaacccatttgggaagtatatataaggtcatctggaaagatttacagttgccatttgctcatttaaaatgtagtgaggtgttttaaagagggtttgttcaatttaccaaaaagggaaaaaaagggaaaagaagaaacttattgttgaacgaacacacacacacacacacacacacaaagagcctggcttaatttagggataaagcaaagaagtcaatacccccacatcaactattgaaacctaagctattgctggagttgacagcgatgattcaaagctaagtttaggaaccacagtgactctccctctgtgtgatttggggtaagatttagttcttctttctgggcctgagtgtcctcacctaaacaacaggtataataatacctgccatccaccattacacagaaacctaccataggacctggtacatacagagttgcttaatatataacatttctctttcttcttgatacagttatagcagtacatctgaaaatctgaaagacatacccatcataggccccactgacaatcctcttgttatcaaaccggatgcatcggaccaattcttcatgtccctctaggactcttaaacaggcaccacattcaatatcccagagccttgaatgaaaaacagacctctgtgaaacaaattcccacacacgattcacactatccgtaagttttttatatctgttccatacagatacaatttttcactatcttggagctctttatttctatctcacttccagtacacaccacacatataaagctgtatgtgtacatttataccatctgtgtgtttccaagcactaacctaggaagaagccttactttttattctatttccttttatatgatttgaaactgtttttaatcatgcgtctgtattactatttaaataaaatcaacaaacaagaaacttcaattctatttaatccttaggcattctcttgatgtctgagttgataaaaaccatgtagacaaatggtgtaggaaagactcttctggggagacagggattgtaggcagtaaaggagaaagagcacagatgagacaaggtgggaaaggagatatcacgtacagccagggggttaagcttccgccccaggcacttctagcacagtggagtccataaggaccactgaggttagaactggcggaccagcaggggaggtggctgtctcttgatgaggcttggggataccccttccttgatactatatgctgaatactgggattgacggtttacaaagtcagagtgggagacttactaggtacacgcagtgttctggtggaaatataaacccattgacaacaccaagtctttttctctgcatatgatttatgtaacaattctggagttagagatcttttttcctattatgactgattttctacagtatttgtagaaaaaaatcatagctagttagcatgtacaaaataaagtgagcaaattaattctataactttttcttagcctctctaccagtaattcctatgatacatccaaagaatgtattttattacagctgcccttagcaaatcttcttagtacccgtgatgatagcatctctaatctgtgatcaaagccattcagtactgccactatgactccaaagtagttcccttctataagctggagagtaatacacattactatcttgtaaaaccttgacaattccaatgaggaagttaagaactgtttattgatgaaacattaagcaataccacaaagcatgatgaatataagagaatcaagatttaagctctaaactaaatttatggtatcttgaagcctaaagtgataaagcaaacttaaatagcttttttgttatttgcttgccttaaaaaaaagttttaataatcttaaacccaatctttattttgaccaaacattaggcaattataaacgccaaagtttagtcacttatgtaaagctactagcatgtgtttgcttgcctgcctttaaaaaacaaaaaactttttttaataatcttgaatcctatctttattttgaccaaacattagtcaatttgattataaaccaaagttaagtttagtcacttatgtaatgccactagagtgtgttgagacagtggggaaatggcatgggataatgaagtagatattgaagggatgttcttagtaagatacaaaatgtctaaggttagtcagatttattagaaagcagggaggccgagtgctgggaaggaaaaagagaggtaaatgacctggcaggaacagatgcagtcttgggagaggaaaataaagtacactcccatgtgttaggtagggaggtgggagctcacaggtgagggaaattggagcgagctgggctgcactgcagcaccctagcctgttctgaagtgctctggtattaagtgatcccaggtggagctgaggttaaaaaactttgtgtactgggggaatcttggaagaacacccagggcacacacggttttcccacttgagtatacagagcccaaatacatttctaaaagttacctaaagctttcttatctgaaacatcccatttaccctgagttgttttgagcattagaactaggagatgagtcaacaatgtggcaaaaatcagcctgctctgtcagcacaccaacttctacccacctaatggtattatctgatgatccactaacaaccaggcgatccctgtactggagacaggcaatgccccgcttgtgcccattgagagtacgaacaaattcacaggtgctcgtgctccagacctgtataacaaattaacagtattttaaagaatgaacacaggaaagtcctctcacaatatacctttcttaaaaagacagagcttctgataatgacccaaatatgtgattataaaatacggtgtcctctaactcaaagttgggaggctggggggcagactagacagcataaaattttcttggctgctgagtaataacactggaatgaaacacggagggaagtgaagtctccagtctttgagatctttacaaagagaacatctcctgaatggttcaaacgctcatttacctggaggaaagagtttgggccagattttatgtttttacaccagctgacatttcaaaccccatggagctaatgtaataaaaaagcttccagctgggtacggtagctcacacctaatcctagcactttgggaggctgagacaggagaattgcttgagctaaagagttcgagaccagcctgggcaaaatagtgaaaccccatctctacaaaaaataaaattagctgggcatggcagcatgcacctgtggtcccagctactcagggagctgaggtgaaaggatcatttgagcccagcaggttgaggctgcagtgagctgtgtctgtgccactgcactccagcctgggtgacaaagcaagactttgtctcaaaaaacaaacaaaaagtctcacctttcatatcatcctcttttccagcatattttctggaacagctccatttgttttgacacattacttctaattgtatgtatgcagaataaataatcccctcttttgtggtatctgacttagatgttcatagacagctaaacatattattagacaaataaggagacacacagcaaccagagtgccctgaattatcttaccagctgcatttgtagctgaatgggatagataaatagatctccacaagtaaaagaatggcactggacccctacctcataccttaaacaaaaatttaactcaaaatggatcaaggacctacacataagcactgaaactatacaagtcttgataaattgaacatcatcaaaattaaaatcatttgtgcatcaaaggacaccatcaaaaaagtgaaaagacaactcacagaaagggagaaaatatttgcaaatcatgtatctgataagggacttgtgcccagaatatataaagaacttataactcaataataaaaaggcaaattaccaatttttaaagtgggcaaaagatttaaatagacatttctccagagaaggtacacaaatggccaataagcatacaacaagttgtttagcatcatcagtaacaagggaatgcaaagcaaaaccacagagtaccactgcacaatcactagggcagatataataaaagagacaaataataggaagtgttggcaaggatatggagaaatcctccatgctgatattatgaaacagctattttgtaataaagctcaaaccctctcaacttccaggcactggtctcataccaattggtgtgactgtgggagtaagttgccgcatataaatcctagttgtttagcttcccagctatccaatgcaaagcctgatgctacacacttcgtgatttgtggggctaggtataagagtgctatccagtgctggttatgaaaaggaggttcttctgagcaagctgaaaccctcatataccactggcaggattgtaaaatggtacagcgcctttggaaaacagtttggcagttcctcaaaatgctaaacacaagcctgggtgacaaagtgagacctggtctctacaaaaaaaaaaaaaaaaaaaaaaaaagggccgggcctggtagtgcctgtactcccagctactccgggaggcttaggtgggagcctcaggagtccctgagctgggggactgcttgagcccaggaggtcaaggctgaagcgaaccatgactgtgttactgcactccagcctgggtgacagagtgagaccctgtcttcaaaaggaaaaaaaagctaaacacagagttaccatcctaagaaaattaaaaacatgaaaacttctacactaatatttataacagcatcatttgtaatagtcaaaaaaatagaaacaactaaaatgtccatcaactaataaacagatgaacaatgaaattttattcagccactggaagcaacaaagtactggctgggtgtggtggctcatgcctgtaatcccaacactttgggaggccaaggactgcttgagcacaggagtccaagactagtctgggcaataaagcaagaccccatctgtacttttaaaaaaaaaaaaaaaaaaaagaagggacaaagctgatgatacatgctacaaagcacatggatgaaccttgaaaacattatgctaagtgaaagcagcgagaaataaaaggccacataaggtattcttccaattatatgaagtgtttagaatagtccaatcccaagacagaaggtagatgagtgatcaccagggactgggaagaaacacaggctgactgctaatgagtgtgagggttttagagcgcgatgaaaatgttctggaactagacaatggtaatgttatagaatgctgcaaatgtactaaaggccacggaattacaccctttaaaatgttcaatcttatggcatggaaactatatctcggtaaagatgttataaaagcataggaaagctaaaattcaaaaaagttagctgagatattggaatcaggactgcatttaccatatcctagggaatcaccctagacttcaactccttgttacaagtctgcctcccccttcaccgcatgctaagcttcttgaaggcaaggacatgtcttcttcatcatcatatccctagcatccggcccagagtccaccgcactgcgagtcctcaaaattaggtgaataaataaaacatctaagctctgccactaactagctgtgatgatcaccaacacaatcctttactctctgagccagatgtgtaaaatggggccacacctaccttaaaagtgctgagtgttaactgagaccataatgtaaagctcccaacacacaatacatgatcaacacgttagcactcttccccttaaaaaggtgatcaagaatttcatgtcatgaaacagaagactgttctctcttctggaccgatggcttttcctcctaccttgcctacaactctacagatatacagagtgggatggcctcaagggttcataagcacagaggagaataaagatcttgccaggtaccaggttggtataagccacctctgctttgtctctgttctaaaagggacaggaacaggtagggttatgactgcagacatacttactttgatggtcctgtcaccagaggcagacacgatgtacttgtcgtcaaagtctactacattgacggcagcccggtggccaaccaggacacggcgtaaagtgatgtcggtcgcagaagccatgtcccacacagcaatggagcggtccttggaacaggtcaccatcagtccattgctgaagcgtaagtgcaatacagcctcattgtggtggatcaatgtgttaagaacttcacccgtgttcacatcccacactctaggagagaagagaaaagcatgatgcttaattatggagacagccaggaaatgattctggtatctgagctctgtctgggtctgcaatggtttggatatagtttgtctgactctaccaaatctcatgttgaaattgatcctcaatgttggaggtggggcctggcaggagatgttttgggtcatggtggtgtatcactcatgaatggcttggtgccattctcataggagggagttcactcttagttcctgagagaacaggttgttgaaaagagcctcctagcacctcctccctctctcttgcttctctctcacatgtgatctgcacatgctggctcccctttgccttctgccatgagtagaagtagctcgaagccctcatcagaagtagatgctggtgccatgcttcttgcagagcctgcagaaccatgagtcaaatacaccccttttctttataaattacccagcctcgggtattcctttatagcaatacaaatggagtaagacagggtctattcttaatgaacctaaggacatgattaaaaggggcccctaaaagcaatttctttatttgctgagaagtgctgagatggtttcagaaaaggtggctaattctggctctgcctgagtttaggtatatttagcagtcaggtatttagggacggtgtttgcaggctcgtgctgatggcaaaagatgattcctctagatagtagattttgtattgagtctgagatgacaggaagaaggaggcttgttggctgaagaactgagaatggttccaagcttagttcttgttgacctctgacaggcctctgagtctatcagttatccactgcaaactgggtaagtcatgatgcctcatcaatcaccgcatccacttctttacccagctgctttatggacaaagccagggtctcccaactgctttgtagatccagggatctggaagcagcatttccacatcacggcttttctgtaaccctcatctcctaagaggacaagttcacatagggcagagggggaaagactcaggcctctgaggctgagacatgatctctggcagaagcaggggtacggaagcactgagtccaggagaggatactaagcatgcttcaagcaggggtggcgatgcttccagcaggggtggcgaaagagtccaggagtgactcctggaagtgagtgtctcctctctgctctggaccacataaccaaaagaagaaagccagcctaatacttggtatatgctcttacaggaaagcatgttgtcatctctacaatgaacagcaataggaatagaacacccttaacaaaaattagctttcctgcctaatttgcgcaaacatgtctacaataaaagtagtttgaaatacagcatgtaaaaatgtaagtttgtgtatgcctctcccagaggaggatgtcaatctcagactttctcagggaaggcttacaagttaagaacaatgaagccagatcactcacctcaccgtagaatctgaagagccagttacaatgacacgctcatcatactgcagacagaggacagagcctgtgtgtcctgttaacactttcaaacattccaggctggttttatcccatatctattgagacaagattagccacaaacgatgattaattatactatattttgatgaatgttactgtcccaccttatgttctgattataaaataaaacacacttgggttacagtaaataagaaacactgaataacaaacaggtaagaaatgacaagaaggaatacagacaatagtgattaactactaggatagatgtgctattttgcttaatttgaacccttagctattgatctcagtatacttatcaacagcctcataaaggggacttcttaaaaataaaatctgtgaaaagaattcgctcactgactgggtgctgtggctcatgcctataatcccaacattttgggaggccgagacagaaggatcgcttgagcccagaagttaaaagaccagcctgggcaacataccaagccaatctccataagagtgtgtgagtgtgtgtgtgtgtgtgtgtgtgtgtgtgtaagagagagagagtgtgtgtgtgtgtgtgtgtgtgtgtgtgttttaattagccaggtgtggtggtgtgtgtgcctgtagtcccaactactcaggaggctgaggtgacagaattgcttgagcccagaaggcaaggctgcagtgagccataatcacaccactgtactccggcctgggcaacaaagcaggactctgctttgtcattttatttttatgtctcataaaaatattaatgaaaaagaattggctcactctctggaaagcaacatgacaacgtctattaagaggttttacaaatgcatacccctacgtttacaaaaacaaaaagtggaaaatgaaatgtccagcatttcataaaagtctcaaagtaaactatgaagtgtttaatgagaaaatatcatgctttattacaaagttaagcattttaaaaatcagaacaaaaattatctgtaaagtgacacaatgactatgtatattttagaaaaggaagaaaggattaaaggaggtaaaatgttgtgaacagttgttttcacactctgagtgttccttttctcgcttcttttactgcctccatagacttgtcttttctagaatgtcacagatttggaatcatacagtatgtagcctttttagattggcttctttcacacagtaatacacacttacggttcctccctgtcttttcatggcttgatatacattcctttttagtgctgaaaattatcccactgtctagatgtactacagtttatttatccattcacctactgaaggacaccttggttgcttccaagtttgggcaattatgggtaaagctgccataaacatctgggtgcaggtttttgtgtagacctaagttttcaattctgttgtgtaaatactaagtggtatatatggtaaaagtatgtttagtttcgtaagaatgccaaactgccttctgaagtggctgtactattttccatttccaacagcaatgaatgaaagttcctgttcctattgctccacattctcaccagcattgggtgttgtcagtgttctggattttggccatgctaacaggtgtgtagtagtgtctcactgttataattcacatttctctgatgacttacaatgtgtaacatcttttcacatacttacaatatgccatctgtatatccttctttggtgagatgtctgttaaggtctatgccttatttttaaaaatcaggttaagctaattgttttttttcttactgttgagattcaagagttctttgtatgtcttttgcatacattttctctagtctgtggcttgttttttcattctccagacaatgtctctcacagagcagaaatttttaattttaacaaagtccagctcattaattctttctttcatgggtcatggctttggtattatatctaaaaagtcatcaacaaattcaagatcatctagattctctcctatgttacattctgtgaattttaagattttgtgttttacagtcaggtctttaatccattttgagttaatttttgtgaagtatataggatctatgtctagactgtttaagggtaagggaggcaatatggtgtctaattgcttctgccccatttgttgaagacacaatcttttctctactgtattgtctttgctcctttgtaaaagatcagctgactatatttatgaaggtatatatttctgggctctctattctgttccatggatctagctgtccattctgttgccagcaccacaccactgtgatgactgcagttttacagtaattcttcaagtagggtagtgttagtcctctgtctttattctacttcagtatcatgctggtttttgcttgtccatataaacattacagtcagctggtagatatccacaaaatcacttgctgggattttgattgagactgcattgaacctacagaccaatttgggaagaaatgactgacatcctcacaatagtcttcctacccatgagcatgaaatatctctccccatttatttagttctttgatttctttaatcagttttatagttttcttcacatagatcttataaatattttgttagatttatacctaagtatttcattggtgggggaggtgctaatataaatgttattgtgttttttgagatggagtctcactctgtcacccaggctggagtgcaatggcgcgatctcggctcactgcaacctccgcctcccaagttcaagctattgtcctgcctcagcctcctgagtagcaggactataggcgcccaccaccacacccggctaatttttgtatttttagtggagacggagtttcaccatgttggccaggctggtcacaaactcctgacctcagatgatccacccacctcggcctccctaaagtgctgggattataggcgtgagccaccgcgcccagccatgttattgtgtttttaatttcacattccacttgttcattgctgctatatgggtaagcaactgacttaagtatattaaccttgtatccggcaaacttgctataatcatttattagttctaggaggttttttttgttgatgctttcatttttttctacaatcatgtcatctacaagcaaagacagttttaattcttccttctcaatttgtataccttgtcttagtgtgttatctaggagttctaatacaatgttgaaacatagtggtgagtggggacatctttgtcttattcctgaccttagtgggaaagtttcacatttctcagcactgtgtgtgacgttagctataggctttttgtagatactctttatcaagttaaggaagttcccctctattcatagtttactaagggtttttatcacgaaagagtgttcaattttctcaaacgccctttctgcatctattgacgtgattttcttctttggcttattgatatgacggattaattgatttttgaaggttaaacatgaagatattggtctgtggttttctttgaatgtcttcatctagtttagtactaaggtaacaatggcctcatagaatgagtgatgaaatattctctcttcttctatcttctggaagagattgtagagaactggtgtaatttcttacttaaatgtttgacagaattcaccagtaactcatctgggcctggtgctgttttggaaagtaattaattattgactcaatttcttcaacagataaaggcctattcagattacctatttgtttttatgtcaattttggaagactgtgtctttcagggaattaattcatttcatataaattatcaaatttgtaaacagggagttgatcatattattttattattcatttaacgctcatgagagctatagtgatgtctcctctttcatttcaatattaggaatctgagtgcttttttttctatgttagcatagctaacgtaattatcaattttactcatcttttcaaagacacatcttttggtttccttacctatttctatggatttcctgttatcaatttcattgatctctgccctacttttcattaactcttttattctgcttactacggatttaaactgttctttttctagtttcctaaggtggaagcttagatgactgatttttagtcttttttctaatatatgcactcaatactataaaattctaagctttcactgcatcccacagattttgataacttgggctttcattttcatttagttacacccacccacacatgcacacatgtgcacacacacagcgaaggaggagggagagaaagtctcacaccgtcactcaggctgaaatacagtgacacaatcacagcttactgcagcctttgacctcccgggctcaggtgatcctcccacctcagcctcttgagtagctgggactacagacgcatgccacaatgcccagctaatgttttttaatttttttgtagagacagggtctccctatgtttcccaggcttgtctcaaacttctgggctcaagcaatcctcccacctcagcctcccaaagtgtagggattacagacgtgaaccactgtgcccagcctcaaaatatttttaaaatttctcttgagatttcttctttgatccatgtgctatttagaattatgttatgtaaccttaaagtatttaggaatttttccagcttcttttttttactgatttctagtttatatccactgtggtatgattggacattgtattaatttctagcctttctttttttattgcttttatttttttatttttccataagctattgtacaggtggtatttggttacctaagttctttagtggtgatttgtgagattctggtgcactcatcacccaagcagtatatactgcaccatatttgtagtcttctatcccttgcccccctcccactcgtccccccaagtccccaaagtccaatgcatcattcttatgcatttgcgtcctcatagcttagctcttacataacagtgagaacatatgatgtttggtttttcatcctgagttactttgcttagaataacagtctccaatctcatccaagtcaccgcaaatgctgttaattcattcctttatatggctgcatagtattccatcatatatatatcagtcacagtttctttatccactcgttgagtgatgggcatttgggttggttccacaattttgcaattgtgaattgtgctgctataaacatccatgtgcaagtgtcttttttaaataatgacttattttcctctgggtagatacccagtagtgggactgctggatcaaatggtagttctacttttagttctttaagaaatctccccaccccacaacaggccccagtgtggggaggcgggagggatagcattaggagatatacctaacattaaatgacgagttaatgggtgcagcacaccaacatggcacatgtatacatatgtaacaaacctgcacgttgagcacatgtaccctaaaacttaaagtataataaaaaaaataaaagaaaaagaaatctccacattgttttccatagcagctgtactagtttacattcccaccagcagtgtagaagtgttccctgttcatcatatccatgccagcatctactgttttttgatttttttattatggccattcttgcaggaggtggtatcacaatgtggttttgatttgcatttctctgatcattttatcatgtttgtcgggcattttttcctgtgttgagcattttttcatatgtgtattgactattttgtatatcttcttttgagaattgtctgttcatgttcttagcccactttttgatgggattgtttgtttttttcttgttgatttgtttgagttcattgtgtttgtttttttcttgttgatttgtttgagttcattgtagattctggatattagtcctttgtcagatgtatagattgtgaagattttctcccactctgtgggctgtttactctgctaactgttccttgtgctgtgcaaaagctctttagtttaattaggtcccagctatttatctttgtttttgtagtatttgcttttggttcttggttatgaaatccttgcctaagccaatgtctagaagggtttttccaatgttatctcccagaatttttctagtttcaggtcttaggtttaaagtccttaatccacattgagttgatttttgtataaggtgagagatgaggatccagtttcattctcctgtatgtggcttgccaattatcccagtactagttgttgaaaagggtgtcctttccccacttttatatttttgtttgctttatcaaagatcagttggctgtaagtatttgggtttatttctgggttctctattctgttccattggtctatatccctatttttgtaccagtaccatgctgttttggtgactataagcactatagtatagtttgaaatcaggtagtgtgatgcctccagatttattctttttgcttagtcttgctttggctacatgggctcttttttggttccaagtgaattttagaattgttttatctaattctgtgaagaatgagaaaggaatggttatgtcctttcctggttttggtattaggtcgtattttgacagggactgcattgaatttgtagattgcttttggcagtatggttattttcacaatattgattctacccatccatgagcatgggatgtgtttccatttgttcgtgtcatctatgatttctttcagcagtgttttgtagttttccttgtagaggtcttttgactccttgattaggtatattcctaagtatgttatttttttgcagctattgtaaaagaggttgagttcttgatgtgattctcctcctggtcactgttggtttacagaagagctactgatttgtgtacattaatcaaaaggaaatgctataaacaggccttcaagaagggaagcgttctatagttccatgactaggtctgagtcttttagtgagcctatacctctagacttcacaagtacttctcagttcttcctcacccctttatgcgtgaccaaatggatgagggggctggagttgtgtatttcccttccccaggtcagtcaggttctataaaatctcagcactttaggctctggctaagcagtttctactgaaggtagaccttatcaagaagtacagaataacctagtatagttttaaaagtttcttttcccttcccgctgctggaaacacaaggagatttttctgggataatcactgagagaatctggtagagctcttgcaggtaaaactcacaaaagtgtggtggggagcctgatgactgggtcctcctcagtttatatttctcagacttgtcccacactgagcctccagcaatttttcaattacggttcaggttaccctacccaggcactggttctcccggatgtttctgctccagtgagttatgattctctgtatttgcctgtctctccaatttgtggggcagcagcttctcctgtgacctcacttctcttatgaatctaagtagaatggttgatttttcagtttgttcagatttttacttgttgtcaggacaagtagcaacttcttacgtaccaaacccactcccttcttttaatctttccagtgttcccaagttaacaatattgttgatatttaatgggagatgagaatgttttcaaagattgaactatttaaaatagactctgtgcacctatttcttgacatgtacaatactatcataatttgtagtgactctacagtttactgcaagtgaacaagattttataaatgaggtagacactgaaatataatatctacaatagcaaagcttgcttttaacttctgacctaatggaacctgagttattttttaaagtgattagtgatcaaggattggtgcagaatagagcaaaaaaaaggtttccaaccactggtctagataatctcttcaaagcgcacttctgctctactattctatgtcttattaagtcaaatggatgtgccacaattaagagaattcttcagaaaacacatctagtgtaaatgaattccaagcccacagccagactatgctttgacaaagttgttataaaccattcttaactattccttaaagaaaaactaccagtattattgcagcactattcacaatagcaaagacttggaaccaacccaaatgtccaacaatgatagactggattaagaaaatggaatactatgcagccataaaaaatgatgagttcatgtcctttgcagggacatggatgaagctggaaaccatcattctcagcaaactatcgcaaggacaaaaaaccaaacaccgcatgttctcactcataggtgggaattgaacaatgagaacacctggacacaggaaggggaacatcacacactggggcctgttgtggggttgggggaggggggagggatagcattaggagatatacctaatgttaaacgaagagttaatgggtgcagcacaccaacatggcacatgtatacatatgtaacaaacctgcacgttgtgcacatgtaccctaaaacttaaagtataataaaaaataaataaataaataaataataaaataaaacgatatattgatagaaaaaaagaaaaaccaccagtattaaatagtagcatatgtcacactttctagagtatactggtagccacaggttagggctatcaagtatatataaaaatagagttcggtgggccaggagcagtggcttacacctgtaatctcagcactttggtaggccgaggcaggaggatcatttgaggtcaagagtttgagaccagcctggccagcatagcgaaacctcatctctactaaaaacacaaaaaattagccaggcctggtggcaggcacctgtagtcccagctactcaggaggctgagggaggagaatcgctcacttgaacccaggaggtggaggttgcagtgagccgaaatcatgccactgcactccagccagggtgacagagcgagactctgtctcaaaaagtaagaaaaaaaaaattaaaaatagagttccgtggtcaaataagttttggaacttgggaaacactgggtgtctgtctctattgtaggcattctcagagcctttatatgctactgtatcctgtgaatttctaagctggagacacagcatgcagtgttatctaaacttccttggagggcattattattctctgcctagaatgcctgccaacatcctctagattcacatccacagaatatcttttggcaaacactgccatacatataggaaaccaacagaacagtttcttatattctataattcagagtgcgtttgacctaggtagctgaattactaaaattccactatttcactttttaaaaaacaaacaaaaaataaaaattaaaaaaaaaagcagaaaagctttatttcacccaaaatagaacaataacagaaaacagggccaagatggagaaagcccactacaatctatctctccagttgattataactaaacactcctgataaaaactagttaagaactctgaaaagtaaggggaaagaggggacaacaggtagatgtggcaaggggtcaaaatgtgaagaaacaatctgcatgggggtgaatttgccattatttttctttgttgttttctgttttctttctttttttttttattttttattgagacagagtcttgctctgaattgcagtggtgtgatcctggctcactgcaacctctgcctcctgggttcaagcaattctcatgcctcagcctcccgagtatctgggattacaggtgcccaccaccacgcccagctaattttttgtatttttagtagtgacagggtttcaccatgttggccaggctggtcttgaactcctggcctcaagtgatccacccgcctcagcctcccaaagtgctgggattacaggcatgagccaccacacccggctttttctcttttcttccttctgtggcttttgctcaaaggcaggcccttgaccaggaagctatacagtgaaatagcaaaacatgcagctaaaattctgaaagaaatccctctaggcagaggggctggaaaaaaagagatccctgggggtttcttttctctcttctctcacagggctcatggctccagtcatgacgacacactgcagaacaatggaaaagataaaaaaattccaagagtgacccaatttttctggccagaggaaaaggaaaaaagtgtccttatgggctgaagagacttagggaaatccaagaggaaagaactggaaataaaagaacccaaacaacacatgacttgggcttacccttgagctgtatatgcgcagaacagactgaaccagcacagcaaaggctgtctcaatgagctgatatttaaagcactgctgaagcctcagattaacctctaagtagtgaaagcccatgacagacgcaaagtggcatattgcaaaggctttgaacagtggaaaagagattagagccatccccgcaacccctctgatgatgtcaagacagaacttgtgttctgaacccaactaagttgactaactgcttaaaaacacacttacccaaaaacattgtccagaggattataacaggacccacagtctttacaacataatatccacaatgcccaaaatactagtttaaattacctggcatacaaaaatcaagaaagatgaacaatctcaggggactggacaatcaacagatgtcaagctggaggttacccagatgctgacatggttaaagatgttaagcacctactctatactccacaggataaagataaacgtgcttgaggtaaataaaaaagagagaattctcagcagagaaatagaaactgtaaaatatcatacctgaaattaaaaactcacttgatggggcggagggtaacaggagaatagagatgaagagatgaaaaattcagtcaacttgaagataggccaatagaaattatccagaaaagggaggaacaaagattgaaaacaatgtggaacaatatcaaaagatatagtatttatgtgattagagtctcagaaggaaaggagaaattggtacagaaaaaaatatttgaaaaaataatggctgaagacttctgaaatgtaatgaatgaaagacgtaaatttacacattcatgaagctcagagaaaggcttcttggatataatatcgaaagcatgatccataaaagaaaaaactggtaagttggacttcatcaaaattaaaatcttctgtcaagtacagtggctcacgcctgtaatctcagcactttgggaggccaaggtaggcagatcacctgaggccaggagttcaagaccagccgggtcaacatggtgaaaccccgtctccactaaaaatacaaaaattagctgggcatggtggctcatgcctgtagtcccagctatttgggaggctaaggcacaagtattgcttgaacccaggaggtggaggttgcagtgagccgagatcatgccactgcactccagcctgggtgacagagtgagactccatctcaaaaaaaaaaaaaaaaaaaaattaaaatcttttgctccattaaagagatcattaagaaaatgagaaaatgaaaagacggccaggcatggtggtttacgcctgtaatcggggcactttgggaggccggggcaggtggatcacctaaagtcgggagtttgagaccagcctgaccaacatggagaaaccctgtctctaataaaaatacaaaaaagtagctgggcatggtggctcatgcctataatcccagctactcgggaggctgaggcaggataatcgctcaaacccgggaggcggaggttgcagtgagctgagatcgtgccattgcactctaatctagcccaggcaagggtaaaactccgtctcaaaaaaaattttttttaaataaaaagaaaatgaaaagacaactcactaattgggaaaaatatatgcaaaacatatctagcaaaggacgtatctagactacataaagaactctaaaaactcagtaataaaaaaacaaagaacccattttaaaatgggtaaaagatctgaaaagaaacttcaccacagaatatagagatggcaggtaagcacataaaaagatgctcactatcatcactggggaaatgtgaatttaaagcaaaatgaggtatgttcacatacctattagaatggctagtatcaaaaaaaactgagatgatcaagggctgacaaggatacagaacaaaagcaactctcaggccaggtgtggtggctgctcacgcccgtaatccccgcactttggggcaggcgcattacttgaggtcaggagctcaagaccagcctgggcaacacggcaaaacaccatctctactaaaaacaaaaaaattagctgggcgtggtgccacatgcctgtagtcccagctactcaggaggctgaggtaggacggcaggagaattgcttgaacccaggaggcaggtgacagagagagactccgtctcaaaaaaaaaaaaaaaaactctcatcactgtagatgggaatgtgaaatggtacaggcactttggagaacagctgggcagtttcttagcaggtgaaacatacacttaccatatgagccagtaaccccactcctcagttttcacgcaatgaactaaaaatttatgttccccaaaaaacctacaggtatataattatggtagctttattcataattgtcagaaactggaaacaacacaaacatccttcaacaggtgaatgggtaagcacaggaaagaggcagaaaagcccaggataagaaacgggcaggacaagggaattgggggaatgagagagctgctccatatcgtgatttttgtaacagttatacatgtctgtgtgtttatcaaaattcacagaattatacaacaaaagagcaaacttccctgtttgtaagttataatgtttttttacaaagtttaaaaaacatgttttcttaaatatgaggacataagatacaaacaatgtaaaataaaatcagatcagatcagccatcaaacagattaaacatggaaaaataatccagtttatctactactgaaaagttaatgaaaacaatataagttgctctatcattctgtggtattattatttgagtccttctcaggaaccataaaaggtaacacctttggtttataaactaccaataccagctggcaaagtaatcaagagccctgtgatactgggatattttctatttacacctaatacagaatatagaatgtgaatgtgcttagagaaggataagaagtgagacaatccagggtcttgtattagtttcggggaaatgctctggctctagttctttagaactacactgagagctgccaagattgagtggaagagataaaaaccaatctagagtaaatggaaagattgtcacatctagtgtctaacacatagccacgattctaaaaataatacataaaaaattcagtcattcaccttaatagaattatctcgtaggccactgataattttttcatcatcgtactgtaaacagtagacacctttactattttcagagcggcactgaatcctctgcaagttgtgtcgtccacaccgccagttagattctatagtctagggaaaaaaggaggcaagagatgagtttttatgaatcaacttactctattaggtttcagactttggcgttgcttccagaaacagcataccaccgataccccaatcttggtttgcataactgtctgtggataggatcatgctcttttccaagtaagacattaacccaacaatgttttttcttaaactttccctgcccatttggcaaccgtcataggatttccaatgagttttggactgggcttgaaaaaactggcctagacagaattcagtatgtttaaagaacgccgtttgcacccaaaacatgcaaataaatagtaactcattgggtcgctccctaatgccaattaaaaaaccatcattaagcatatattgacaatctacatatccaaacaaagaattgtcttgatcactgaggaaagatagtgagcaactactataagccaactacataggaagaattttatcatttttaaccttcctaatgtttctgtagagtaaaaatggtacattttagccctagattcttattcctcttatcattcatgcaacatttgctgagatgttaatatattccacatagtgtgctaggcactgaggataaaaagatcaacaggagacatactgcattcagggaggcaccactccaatatctaggcccatggtgtctggatctagagagacactaaactaagtgtatttggttaaatgatccatacaataaccttggaaggaaggaagtacttattatttcctttttacaaacaagaaaacagagtttaatttgcctgcagccacaaaatcagtaatcggactagctggaaatcacactcagttctttccgactccaaacccatgcttttgctactaacatattcaatgcccacaaagcaggatgggcctgcctcttgcggcagtgcacacagaacgtaagaagatcagtaacaattccaaaagtgccaaatgagtgataaaaattctaagtgctgcaggacttaagggagataatgagctctatagcctgagacactgggacaagtttagtgaagaagtaggtcatacccagagcaccagaagacctaacctctggtagtagacataagtgattttttaaggctcaaaagatacaatgtctctactaagagtaactaaagtctgaattcttgatccttgaaattaggggacaacagggatttctataacctgttacacttcagttcaggatatagtttctctctgagtagctaattatttctgtacagctaaaagtctaattatttgctttgttgaaggagtacttaattactggctctgctgacatctaacaaactgtatttcttcttattttgaagatagtatccttctgtgcactctaaaatgttacaatttactgaaagctacatgccaggcactatgcttttctaacactataccactcactttatatgttttgtagctaatttaatcgtgactctgaagcaggaatcattgttcgcattttatagaaaaggaaatggagggttggagatatcgatacacgtatacttaaaaagcgattatttccatcatttgtggccccagtgctcagcaagagtcctggaaatacggtatcttccctcaaggagctcccatacacatcctgagggcaggatggtatatttccaatgctcaggagatacaaggaggtgccatggagatgccaggagaggggaaatactcatttgtccatctgccaccaaatcagaacttcctagcctgggtcatcatctctagtgacttggtaaaatattagacatacaaaagcacacttcaaaaccaaaaaaaaaaaaaaaaaaaaaaaaaactaacccaaccatctctgctacctctatcaaagtagacaacagatctgtccggataagcgactttttaaaaagaggtccagaatacaggcatttcttaagcagaactcaacgcatggaatcatttagagaaacaatgtatttttagatagtgactgtgccatctcagcatgctaagcactccaggaaaatgctgatttagtaggcagatgtactggtaacaagtctaatttgtggccagtgactcttggcagtagttaccaatgttcacgttataccctctgggggcccacagagttgctacagaatgtatgatgtcatattacaagtatgacagagatgaatacataatatgtctttacatatatgtcaagtgttatcaagctgttcttaggtttaagaggtatacaattgctttaaaatgacactgaagcagtaagtagctttgttatgctctatatttcaatgactagaaaaagcacatttactaccgcatgagagtctgagggggaaacaattattttaatttaaaagaggggatgggggggaatctctataccaaaaagaattttctccatgctctccgctgctctaaaatgtttcctagaagtgggtgatgtggttacaatctttaactgtacccaaaaccctgaagacgcagcagagaagactacacagaggagccagggtcaggtacatactcagcctgtgatacatcagtcccctgagatgtctggacagaggacgacaacaacattaaaggctgggctataccctctatccccaaccctcaagtaagagctagggaacaggacctctcaaaagctctgctagataccagactttcattctaagttgaacagaagttagcaaatggcttagcttctcaacacttataaaaagcctacttttctcaaataagtttctgcattttaaaagaaatagtttgtcaaccaattcttgatgtgtcattttacaaagtcctcgcctaggcctgttttagaatcattagtttcttgaatcccaaagtgcagcttgctttgaaaagccacgaaagagacacggagccagatgagggagttgactgctttgctgcgcaccaatcctgggtaactcctcttctcaattcccaaggccaccggcacaagaaagcagcacttcctgtcaactacgccggcctaaaaaactgcccccatgatgtctgacaaccttgactcttacttgaatgcttataacccaggtctttttttttttttttttttctagaaaaaccagacctttaaaactggcaggtagcccactgtggtagaaaatacctaggtcaagtagtaactttggcaaaggactcgctgctgtaaagatgggaagagtaatatctactccctcaaaaccactgtaaggttcaaatgagattatgtatataagttctcattatggtgccagcaaatggtagcagttatgttcttcttcagttgttgaaaacgttaaccaaaaaaaagtgggctgcaacaacaaatacatatattctcacaaagttgccagaaattgttgtctcagtctaggctgatatttaatgctaataagcctgagccttccctaaccattcccaggaagaggctcagccttcaaatggaatccaactattaccttaatgccagcagcaggaacagaggtcatacacaggtgcacctctttatatggatacctatcatttcacttagccatcatgtggtatggctactgtagaggaatatttcatgtttttgagaacttgtaaaatccccttaccctgcgcaaattttcaaaatactgggaaagtagccatgatacacagagtatacagcggcatttaaattggcaatagagtgaaaacagatgtctgagtatggaggaataacattatttttagaagcctaaacacaactgggtgggtgggcaagttttgacattttctggtcaggacaatgttaatatcaggtttgcaaaccacaaaaaagctccccactttccctgaataaaatgtggcttattaaaaggtgtgatacaacacaccatcatcttcccagtgtctgtccaagaagagcacttcggaggcgttaatgcaatgaatgaagagaggaagaaggtagattacttgaaggagtttgtcactactcaaatggcaaaagagaaaaatccaagttcagaataccagaactctagggctgttataacaactcctatctctctgttaatagacaattgggggcacgctagagtgaaagcagcatgggctttgaagtaagaatctcagctttgacaattcgaggattaaattaaatcacttgtagcaaagtatccagcagtcagcccaccattaatggtaacaacaacaataataacagcaacaactaagactctagacagcaaaggagaatatggctgcttcttttaggagcgagcctcaggttttctaggaattccttctcaattcagaggccctctaaaccctctctatgtgtggcaagaacacccaggcgagatgagcctttgcagaaagcttacaatacttatttattctccccagactccatttctcacatcctcatttcctgaataacaggagttggctgcactaagccaggttctctattttcccttaaaattaagccaattttcggtgggtcaatgtagaagcgcagattcagagatgaacatttcctttctcctcatcagagccaaatctgggaacgtacagattacaggagctggcacataagccaagctgtcgaggtggaggaagaaggaaaaaaagaaaaaggtgttgtgaactggcaaccttgcaaagtctaagggaaacaacacaagagactctgaagctatgtacaggcaactggggagggaggggggacataaacagccacttgacattccaagtgtcatttatctttctgcaatgtgcttaaaaccctactactttcccataactggactaaaacagggcccactaatcagatcttaactcatacccttttttcaacgaacagtcaaggacactgcgtattcacacaattagagaaagaggcaaaggccaccttgaaattcagcaggcataaaacatgcctctttctccctcacttcctgaattttccactctgaaaatgacaaacaacaactctcagcctggatagagctagacagacctcagttaaaagcccatcccatctcttctacttaactatgtagcaagtcctaaaacttcttttagtctcagtttccccttattataaagataataacatgcaccttgttgtaagaataaaaaacaatcatctatgtaaatcacccaacgtggtttgatatatgcaaaaactcgaagtgggtatttgtaattattatagtctgcttgtgaggatttcataccagtcatacggacagagccaagcccgtgagaggctctcatttgatccatggatcactggaagaactctctacataaaactctatatattctgttttattccagacagaataaaacacactctcaaaatgggagtaaaaaaaaatctattttgaggtggtagcagtggtctattgttaaaaactcgtattaagggtagaagggtacatggttgatcacagactctcaattacccactagctgtgtgatcctgactaaactgtttaacctttttaaccttctaaggtttcctcaaatttaaataagtacttggcctacctttcaggttttgtccaaaatgttaaaagagaaaatgcattataaagtagttaacaaagtatctggcataagtaaatgctattagtggtacattacttttatgattattactagtagcacatatatcaaagtataaacatcatcccttatatcaagaggtctagcccacaaaaatctggagaagacttttgtggccaaccagtgggtttttccaaaccacactttaagaaccactgggtagaccaccatgatgtagaggctgtgtcgcacagggttttcccacagagctgtttcccctcacacctgcctcctctcctactttaaactatcatttcagcctgaagaagtgatgatggcaggtggtgtcagatactgtcatgccacagaatactgaattcacattgtcaattctaacagcagtcatgaggattcaatcaaactatctatgttgccacatcttcaacctgatcagagttcttcaaggttcctgtttgttcataattaactttaaacatcattcttttcaaagaatttttttgataaaattattcaaagaagtctggaaataactttgtaaatagttgcccctcatcaagtgaaaaaaaaaaacagagggtaatgtagtttataagatgtgtacataagaaatgccttagtacaactacctggggtaagagacagccccatctcccctacaatacacacacatcaacctaagattaaagttaacaccatgtctcagccactagcactgtaggggcaacttattctaagtttggaactgccaatggtcaattaattcttaaactttatgatttatctagtgaaagtttttatttaacctccttaaagggttactttatagatcatttcagagagcagaatattcaagacagtttgggctttaaataatgatattccagtcacattcagatttaccattaatggaatgattccattattcacatctgcctggaagggtggtggggtctgaaaaagcacatgtttctccgttaatgaattttggcacaataacttttatgtctatcacctgggggagaggattacttcacatttgggaaactgagtataactttatgggtgatattgcattgcctagcaaaggctaaagttttctgccaaggaggaaacagtgaagtaaccaagacctgccaagaacacatgtgaaagagttaatgagaaatgcctgtgcatgtctttcctggttcaaggaaaaaggctaaaatagtaaaactgaactaattagaacacatgaacgatatcaaacatctccaatgtttctcatcaagtttacagagttttactggtctggtgaagttacgctcaaatccaaaatggtccaggagcataatttgccctataaaatccacttaactattgcttagaatgatatctgagtcatgtttatgaaaaactatgagtaatgtacagagaaaacttgaaatgtgccttctctagttctctagagatggctcaaaaatgtaaaacaatgcttacttaaaaaaacggggccttggattttggaaaatttatcagcttagaataaaaagatgattttagattaaggtttgaattaaccggcagccttgcagaagcatttcatgttttagaaaagttagatattctttgcaaaagacattattttctctgcagaatagctgcagattatatacaacatgacacatttactccaaaagctcaactttttaaaaaaaattattagttctacgattttagaccaaaagaacactctaaggcaacataaaaagttgagaacaagaaacaaagagcccataaaacagataaatcataaagttacctctatatcctggataatctttgggtataatgacctataaaatgaatttggagggccatctgtgggtctgtttttaaacaggtactgatccctggcaaataaaaacaaacagatgttacatttttgcacataaaagggtgaattttatctaaacatggtgctgacaaagatatatctttcatgtcttttaatttgcattgagttttaacagttcaaaagcaggatttctgacaaatttacatgttacagacaagtttagctcaattcacagctctctaacaaaatcctgatcgtgttttctgagtactaatatgtaacaatctagcctttcattccatagagtttaataaaaagcgctaatgtagctttgtgaaaaatctaacttagtacacatcaaacttcctcccgtaaggaaaatacagccctatatgcacctctgtctgtagctctctctctttgctaactgggccatacagcatacagctagctataaagctgcatcagagttatgagttttctctgaaaaatcctatcactgttattacttcctcaaccagcagtaataacaaacagcaaaatggcactatctgactttctcatatttttgtcatatctatattttggtaatggtatcatcaactaagcaaaatgtgaaggaaaaaacataaatacatagctttgaaacgccaaatcccatcaaactatataatacagttcataaaggaaatacacatttcagagggagaaattttaacagctttaactttttcttccaacttttgaccactcattttcccccctttttaaaaataggccagcacatttgcaagtataattgcatttttgagtaatcaagctgactctatgtcaataaaattttttcaagggaacaagcaacccaagtacttaccaccctcttctttctgaaagtcctttccataggggatcagtgcgtaccattcgttcaatcagcttcttccaaagcattccttctgagatcactcgctgccattctttacataccagctctgctgcacacagagacctggcatccaggtacgaaagaatgttttctgctatgtgatctaagccttgctctacaaaacagaaaagggaatgaaggaacgggaagagagatagaaaggtaccagccatcatttccttaaagataagaggaataaagaaatcctgaaccaagtaaaatattttagtcatatcaaaagttctacagatactcaaatccatgagtacataaacatatacacttctttttggttctgattttttacgataaaacaattgatagcaactcttctctgtgtgtaaaagctgaccttggacagttctgttatttgtcaaatattaagataagacttttcattttcttttatataactctcacagcactcctatagggcaatgacgccccaagtttgacagatgaagcacagaaaggtaaagaactcaagattttacactcccttggctttactactggaactcggatttcttgcttcaaagtttgtgttcattcccatcttactcactgtctctcataacaaatcatatccccattaatccatacccggtgtgaatccctgggagatcagaagacaaaaaaggcaaaacaccgactcatcttgaaaaacttatgaaaagttaaatggcaatccaagaattaaagtcgattgtgcttaaatgtatttttgtcaatcttttcatctccctttcgtgagtatccattttctgttcctaaacagatgggacaatcctcaaaagcaatagccccatgtctacaaatcctagaatcttagaggtcattggcttcaacctcccacgatacaaggatactctcaaagaaaaccactttcagcctctgcctgacattcacaatgggaagatgatcaacatggccaccactgttgccacctgtaaactcccatcctgtggcggtaagtatgtcttctacagttgcaagaaataaagcttctccccaagcttattctgtgtagggacgagaacacagaacttatcatcagaaaattcccatttcaagtcccaggttcaccacttactagttctatgacatgaaacaaacactgaaacatccctgtgccttgaatttttgtgccctaacatacaaaatggtaatcaccagtaacaactatcctttcttacactgtctgtcagaatcaaattcaacagttttatgaaaacattttatagacaagcactctacaaggttaatatctgttctcttttctcaaaataattagaagtagtataatagcactaaacttggttgttgaaaggccagatgtaggtaaattattaaactttcagagtcagtttcctcatctgtataagattacgataatctctacttgattctgaaaatatcaaaatgagatgatgcatgaaaaatgctttacaaactaaagttccttcaattctaagaatgactattattataccattggttataatttccaggtccttcatatactaaaattctcttactctggactagatcaaagacccaagctatggtctaagaataaagactacactgggaccactgtcctttcctgcatgtcatttacagttaatgtggtcaaaggctgcactgccttcatctgatagtcatatcacagaagacgcctaagatggcagtaagttagaataaaatcccaggcctctcccccaaaaacatctattgaaacaatttccccgaatgctctatttgcacagctagttggaaaggtggggggcagctttgtgcggtttatatttatccttactataattcaccttcaaagctttgtctgacccatccatttcagtctctagaattctgatttttgtcacacccagaagagtgggtattccacaccagacctgcatgatgggctaaagtactaaggcaaacatgttaaaccatgttggcaaacacgttaaacgggtcagaaccaaggacagcacccatgacactagctattagtacctattattataatatttccctccaagctagcactgatgccgcatcaatatgcccagggcacccacactgcgacatccggtctgtagtcatctatatgtgccattgcccagtccatatctctctattctgtcctcggaggtatttggaaaaatcagcagatgatgatattaccatctatttacatcattcttcagacctacctactagcctggtaactttatccaaaaaggaaataaggtgaggagggtatggctgctttcatgttcccgtgctggggtttactacataaagttgtattgcaatttttcacttacatgttgacactagctgcttggtaacccttttaaacatatctagttcatgttcattatagaaaatttataaagtgtagatgagcaaaaatttttaaatccctaaaccccatttcccagagaagggaaccacttttcacattctgtatacatccttctaggtttacacaaccatacacaatcttttcagaggctgattagcctttgaaactcatctaagaattctgctaaagcacaacatcaaatttaatagctaaatcccccaaaaacaccttctccagttcttaaaaccaggaagtctgctcatcaatcatctctggtgctatcatgcaagactaccatgtgcaactgtacaagctgtacagggcacaattgtacccaatagttctgcatactgattttcaattgcttcacaatgttctacaatttgaaaaatcacaaccacaggttttgccactatccaggcatacaatgtatttaggcctacttgtctataggagctatgtgattgctaaatatcttcacatctttctcaaacacaactttgctaacctttgttttaaagccattattcttgggttggggggatggtgggattaggttaatgggagtgaaaatatgttgtttctttctattatcactatactatctattctaagcacactatcccttcatcctttataatctggctccaaatagttaattattttgttttcaactctttcaatttacttcaacattttggacaatttaacattatttggagtttggtcttcttggtaccattctcaaaggtttcacagggactcactctatcacccaagttggagtacagtggcacaatcatggctcactgccacctcaaactcctgggttcaagcaatcctcccacctcaacctcccaagtaactaggactacaggcacatgcctccacacccagctaatttttttttatcatttgtagagatgaggtctcactatattgcccggggtggtctccaactcctgggctcaagcaatcctcctgccttggtcttgaaagtgctgggattacaggcgtgagccactgcgcctggctgcctttcttccatcttctatgtttacttaaaatcagggaaatccaaggataatcacgtggggttctgcttgtgcctctccatcactaggattgacaaattattcatcagaatttcaaactgcagaatccgtcagccttcttttatcacatttttgttcagtctctagccgtggactaacagacttagctctttcaatctttctaacgctggggtacttatctatcttccttttctgatttctacacttaatattagaacatagctaattacagcatctcactctgttgcccaggctggagtacagtgacatgatcatggctcactacagccttgaccttccagaatcaagtgatcctcctgcctcagcctccctagtagctgagactacaagtatgcactaccatgccaggctaattttttttaaaaaaaattttagtagagacaggatctcactatgttgcccaggctgagaacatagccacttttaaagtaatgtaaacttcacatcattaacccaaatcctcctaactggttataaacacatctcaaactaattcctctctagaaccctctgctctctgaaaggtgaaacaaatggcaagacaaggatgcattaggggctgcatggtggctcacacctgtaatcctagaactttgggaggccaagatgggcagatcgcttgagtccaggagtttgagaccagcctggacagcatggcaaaactccatctctactaaatatacaaaaattagccatggtggcacacgcctgtaatcccagctacttggcaggatgaggcgcgcgagaaccacttgaacctaggaggtggcggttgcagtaagtggagatcatgccactgcactctagcctgggttacagtgcaagactctgtctttttttaaaaaaaataaaaaataaaaagaatgcattagatactcgccttttcaaacctcaaaggctgcaacatccccatcatctgtgacgggaaagcagcacccaaaccttcaacctatctgggtggtctataagcctgtgtggttgtatctgactcaactcagggttactgattttcaaaacaacagcaaaaagaaaagatccccccaatcttctcctgacctacaaaatcagaatctctagacggtaaggcccaggaatctgggtgtggtttttttgttgttgttgttgtttttggaaacagattctcactctgtcgccagtatggagtgcagtggtgggatctcagctcactgcaacctccacctcctgggttcaagcgattctcctgcctcagcctcccgagtagctgggactacaggcgcacaccaccatgcccaggtaatttttgtatttttagtacagatggggtttcaccatgttggccaggatggtcttgatctcttgacctcatgatccacccaactcggcctcccaaagtgctgggattacaggtgtgagccaccgtgcccagccaggaatctgtatttttaagaagtgccactagataatgctgaagtattaggaactattggtttatagcaatgatatcccttttagtcctctttgattcccccatcaattgctcacaactaggctatcatgagtttttacagaaataaatcccttactaatacttatttcttcctctttcaaatgccatcagtccaattaagcaacatctcagtgatatctatgagatttgacctatttcctttgtctgatactttaaatgcatttcctccttctatgaggcagcatgttttagtcttgtgaaaaacacactgcctgaaagtcagaaaaactaggttgcatctcagttctgtcaactgctagttgtgtgaccttaagcagatcagttttccttttaggatctcagtcttccataatatcagaatgatattaaatgtctgaaataaattacatcatataatcttcacaataaccttctgagataggtactctacataccctcattttacatagagggaacctcccagtcttgctgcgaaagtttaaaaaacagcatacgtaaagagctaggtaaataagaagttcactcaagaaatatcagtctttgttctactctcccccaaatcctctcagcagatatcaatggacaaggccgatacacaatattcttcttgttaccttctgcagaaaaaatactacgcatctcctccagcaaaaagctaacccccccccctttattttcttggtataagtctcatggccccttaaatgttttgagaagaacaggaatcacacaatctctattcaggtaccttagagtggccaccctcaggagccatgcagagcatgtaactttctggtttcaagcctattcaggacaaagaggttactgaataaggtggtccatttgcctgggctaaaaagtgctttgaggtgttaaaactaagcattttctgaagtacctatgtctggctctcattactctatcatgctgagactcccccatctctcaccaccaccccctcttcctaaggcaacaagaggacacattacagcctcagaaaattgaggccataatacttcgcacacagtgctgaagacatgctgctgttgttaattacaggaaccagatgaaagtctggaaaaacttcaataataaattaaaacaattaaaaggcacaaatttcaaagctcaatatgtaaataacactgtatcaaaactcaaatgtcaattaaatgcccttgactacaaccagttttaacacagctgcttagatcatacaattacagaaacttttattattttagaaatgcatttcaaagagcagctgcaaagaaacttcctttcccacccacccgtgttatcccttccccctccctagtcacaaatctagttgtaaaatctgaagttctaaacgttttaaaagaaaacaatgcaattgctaacagcaacagtccctcaacggatgcctttcacttggaaaacaccaacctaaggtttcagacagaaatgaagtgaaaagaagctcaggtcacaaagtctaacatcttttttccataaaacacccaggaaacaaaacaacaaagtgacagacacctatatgatgtcagaatgaatcaattcgggaatcagtgggtgaataattaaaatttcctaccaataaatcttactacctctggagaagcaggtgtttcctgcctctctgggctttttcttaagctgccatcctcagagtacccaatagatgccaggcatattataacatattatcattaatcctcacacaatacccataaagtattactattattcccacacagaggaggaaactgaggctccagaaagtgggaccacacagctgtaaagtgtaagggctaggattcaaaccaagggcctgtgtgactccagcacccatgctttttcctgtcacgctgctctggccgtgtacccatcctaaagccttatctacgctctgtttcttccacatctcctgggacttttaatctaatctctgtcacatttatggtccataatggcttatcatcctttcttggggataagacaattgaataaaccagggccagacagccaagtgtttcaaaactcttaattgcttagacacctcaacaaaccgatcaccaatgcttatcatcctttttgaagtacaatctgtccctactttacatggtatgaattttcccattaacaacagttcttacaaaccgcaaactcagcctgcagaaattgacattgcagactaaacatttactatgatttttagaaaggcatatcataattatcactttttccactgagccaaaaggagccagagaccacaaacattttccattttccctatactgacaggtatgatattcacagcaagcatttaaaagctataattataatttttacagaattaatggttttcacaatcaaatgaagtcgtaagttgactgtcaatttcaatagtgtaaaaacctcaaactcaagatgatgtacagtaaaaatgaaacaccaaactagtataatgattcataagttgctccacacattattaaatctaagtatgaacatggacacagacctgtttctcctgtgatgctcttaaagcagagtctgtgttaaggaactaatgccatgtttaatctaggtctactagatactaactaacacaatcaacttggccagctcgtcctcagctattagattcatatgtatgatatacactgacatatgtatatatgttcagatcaagtcctgttaaaacaaatagcattttaactaaagtatttccatgtcccagccaatggtccattcatttcatgtaatattcaataccacaaaattccactttaacagagatatggacaatgccttaacattcgctgtaatgaaaactgaattgtatgcaattatactaaccatatttatatacataacacatgttcatctgttctgcttcttctccaaggctgtatactccctaagagatggggttgcctctgaactatactctgaaaaatcaagagaacttcaacagtgccaccttgtggctactctgcaaatacaaggtgagttccctggccctctaaaacgtttgagaagcaaattacagggaagaaaataaaaccaaaacggtggaaaacaaacaataaattgaattgcttgagaaaaatgaaggcatcctctcatcagttaaaatcacttatgagggacaaatacaatcaccaacttaaaaaaagactctgtcttttcttggtgtgagatgcagtctgattctataggtttctgggtttgagttctgcacatacagagaagctgcatcatatgtacatgcctcatcttacttccattcacctgtaattctctctcacgcaatcaaaagcatgtctccatctccccctccctggatccctccctcataattaaaagtgagaattattgaactgagttgtaatccttacattcagtacttggggccaatttaaggaattttccttagccgttgtactaatttttgaaccaacccctaccatcattcacatcaccaccactataatcaagatgtgtgattctgggcatctcacccaattaacttctccttggcttcctaatctacacaatgaaaaacaggactaagtgatggctaagatccccttcagcaattaaatagtatgattctagaaagagaggatttacgttttgctttcctagagattctaatggaagaaatgagcaagtcatgctagatttcagcataaaaagaacggcagtgtcaaatttttctaagctaactctcaaatatccttaaaactcccattgtagaaggtaaacttacacgttttggaagagagattagaaatcagaagctggtttgtcaatttgcagcctcaggtttcaggcctgaggcctgagcctgggtcttgtttgctgtggaagtacttagaacatgagtcttgtttgctgtggaagtacttagaacacggagtcctgatgttctataaatcacagataggctaagggaggagctactctttaagaagctatcctgtagctctgacaagggctagggttgtggtaatggtactggctcatccctggctacttctaggcttattttgacatggcaattttaaccacacactacactggccacatcagaggaaaacattctggccagcattctctataggagtgaaatctctatatcttacctagccaaatttaaattgagaattttttaaaaaacaatatagaaacagaaaaaaattcatgattaatcatattcaaaggggagttcagcacagtggtgcatgcctgtagtaccagctactcaggaggctgaggtaggagtatcacttgagcccaggagctcaaggccagcctggcccacacagcaagatgccacctcgttgagaaaaacaaaaaggtggtacagaacacagcaaattttaaattattttttaaaaatcaaagggaaataaataggtggagcacagtgaaaccattctgtaggagactcttaaggcagatatatgtcattagacatttgaccaaacccacaaaatgaataacagcaagagtaaaccctaatgtaacctatgaatttggggtaataatgatgtgtcagcttaggttcatgaattgtaacaaatgtactgctctgctgtgcaatgctgatagtggggcaggctgagggaacgggttatgtgaatatgggaattctctgcattttcccttcaattttgatctgaacctcaaactgctctaaaaatataaagtctacttttaaaaatcaaagtaaatttaaccagatgtgtgtgtgtgtgtgtgtgtgcacgtgcgcgcgtgcatgtacacacctatgtgtgtatgagacatatatgggaagacagtagtgagggagaggatgcagaaacagcttttgagaaatataataaagacatgctaccagttttcccaatgtatttttgccattccttaagtgccacttcagatacaaatgaatgccctaaacttttgggacacttcccaaacatacaaactatgtttgaagggaaaagagtaccagtttttttaaaattacatacaaaggcaaagtgcagactctaaactacatcaaaataaaaagcatatcattaactcattcaacagaccaaatgaagcaacagttatgaccaataatgaacactttttttttttttttttttttgagacagagtctcgctcttgttacccaggctggagtgcagtggtatgatctcggctcactgcaacctccacctcctgggttcaagctatcctcccacctcaccctcctgagtagctgggattacagacatctgccaccacccccggctaatttttgtacttttagtaaagacagggtttcaccatgttggccaggctggtatcaaacttctgacctcaagtgatccacctgccttagcctcccaaagtgctgggattacagctgttaagctactgcgcctggccaggaatgaacattattaaagatactgcctatatttcctagatagatactaaattataattcctcgagttccatatattaaagtatgcgtcccaaagaaatgctgcctcacacagtactcattcaatcatttcataaatatccacctaggtccttgggccgggcattcttcaactgctcagcttttgaaaagacaagtacagttacctggtaaagcggtaataaagtcccgctgcaacatgggcttcaggtaagagttaatatgtccatgctgataatgacacattcgtgaaataagatgttccacaaattccacttgatctgattcagaccactggtcaaaatatttaatacacaagtctttttctttttgatagtttccttctgatggcctctttctggagacgatcacagatgatgttccattacttatctattttagaaaaacaaaaaaaaaattagtttaacaaggaaagaaacctaattaatatttcattagaaatatttttcaccctgtgtatttaatcttaaaatgccacttttaccctaaagccaaactcattcctttactaattcattcaggaattaaaaatgtattcagggtctgtgtcctcaaattagtcactacaggaaatgccaaaattgtagctatttctaaaaggcaccttaaattatcattttccaatgcttactacaaaatgatgctccaaaggtatatactgggtatctctatacacgggatatatatgaattatcatctccaaagatagctaatgctggagataaccatcttagagaaactgctcaacttggcaaagtggcaactgattattaacagtttgttttacttcctcaaagttcaaagttaatgctacatacatttatgctaatggttctcaaacttgagctagcatcagaataacaggagggattgttaaacacacagattgctgggtcccaccctagaggtttcggttttattagtctggagtggagcccatgaatttctatttctaacaagtttcccagcaatgctgatgccacccgtccagagactacactttagggaccacatgttgagaaccacaggtctatataacaaagataagctgtgttgtgttgaaacctgaaagcaattcaatccaaaaagcttcattttacccaacagtttcaatctcctccatactttcccagggctactaatctggcagaacggtttagactttcccatccttcttttgattaccttctcagaaagtgacccaaggtaaataaaccatgtatacctgaaaagctctgcatcttacgtaggtggtttatggacaactcacagactcttatactaacaatgcatttctcatcaaatcttcctacaagtccttacataaaatcagtacatattttttaaaactgaaactacatacactgcatctggacagtaacattaaaaataatctcaatcactagactcaaaccacaactactatgaagtgcagtaacctccctgtctaaaaacaaaataacctcaatacttttgtcaaacatttgtcaagctatctattgaccactattctgacagcctcctcatacataataccagaaaaaataacacaaaagataattctaagaactgaagagctgaattacaaatacctattaattccgttaggaacttatctcaggagtcttacatggaatgaaccaagagctttcactatcagtatgtcccctaacttaaagtggactaaatccatcccagagaaaacatcctttataaatatccaaaggagtcttcagttttccttcacacaaaatcttgtctgaagttcttatgtccatatttagaggtatgagatgggaaggcatctatcttccactcaatttatcctagcgccccactgtcgaggaatgtttcttcccttgtatcttgggtgaggaaaagctcactgacaccaggtaccaccagggggaagcattgaacaaggattttgaaattttgcttttactaagacatttgagtcttaacagatccaaaaaataagagttcaaaacagagatgaaaagtctttgctgtgatgaatattggcaagaataaggggcatctaagttgctttaagcataagaatgtccaccacaatataacaaggaaaagttagaaataactgcccaattacaggcaactatttaaaacaaattctaactcatcaccattaagagctataatgtaagccactaaaactagcatataaagtaagattttggccaggcatggtggctcatgcctgtaatcccagcactttgggaggccaagttggctggatcacttaaggtcaggagttcgagaccactctggccaacatggtgaaaccctgtctctactaaaaatacaaaaagaattagccaggcatagtggtgggcgcctgtaatcccagctactcaggaggctgaggcaggagaaatgcttgaacctgggaggcggagggtgcagtgagctgagattgcaccactgcactccagcctggggtgcacagcaagactgcgtcaaaaaaaaaaaaaagtaatatttttatagcaacagaacatgcttatgaaataatatcaagaaacaaaaggcaagatccaggattttataaaacattatgatcacagtaattcatgacaaggggaacacaccatgacagagtaaaggatatacatcaaaatctcaaaagtgccttatcttaagaaaaaaaactatgtatgctttccttccccctttatttctatatttgattccaaataacttgccaaaataatggttcataacaggttaaatataatgataacaacttgcatttgtgtactgctttataatttacaaagtactttcacagccattaattcatttgataaacaaaagtgttattttatttacagataagttcctaatcatctggcctccctagagtgtttgtataactattaactagttgactgaaagataaatgaaagaaaaactgaaagctaaagtgtgaagaaccactgccaattgaaaaatcatagtaaatgaagagcatcccactgcaaaataataaacgtggagggtacaaaactcagtctgtacacagtgttaagaagaaaataacagcatgtgcactattctatagcacattttcaatatgctatttccagccacgtgctcagcccagcaagctcttcctagcattgtttttctttgcttcatttcctcttaaatgtgttggatgcactttgttcctgctaactaatctatcttttcagtttcaaatcaaatgaacccagagaatttatttttacattattatcttcagatttagatttgttttgcttttaatcctgtcttcatgaaggggaaagccatgtgtaccagcatggttgataaaccaccaaatcgtgaaactttgcttgctccccaaacccccaaccacacacacatacacacacacacacacacacacacacacacacacacacacacacacacacacacacaacctgggaaattgggaagaaaactggcaaaccttaaactagagccaagggagaaggagacaagcttaaaaggaaaaggcaaaccaatggaaatgggagagaagagtaaaggttgagagcaaaaggagaaaaggtcatccatgtatacactggtgtgtggcatggtgccattctggtgacaaaggatgccatcactgtccatctttggcttaggcagaggccacagacagaacattttaggctacagccaacttcagaatctttgtggaaactccaaaattatttagcatatttgtaatgacaattccctatggaatgaagataaattagggtggattctgaaactagcaaaactgcacaaaagaaaacaaaatgcttggctcttgattccactgaggacattaactgagggagcatcctatctacagtaagtcagttgctatctaatctgtgcgccgtcattcctacctgccaaagagtatttttctttggggactcatcttcattttgatcttccataactgaagtgttctagggggggaaaaacaggttatttgaattataccaagttttgcaaatcctaaataactacaataaataattttgaaaacccaaactagagtgtaccaatacaaacccaagaactatttggctttgtggctaacacatgccattttgggtcaagggagatgtgctcatctttcataaatcgataaagttagtggttagacaaaagcaagcataaagtcattatttacaaaggttgggtgtgcttagaaaaaaaggctaaattgtgggagtaaggctgaggctcaacctccgtcatcactgtttttgtacttgtgacaagaaattccaaagacccatgaggtttccgatgattgcacaaaacatttactagaaggtctgctattcagtaatgcaccccaaggaatccgcaattagaagtagcaaagccttggaagcccccctgccttcgtctttcctcccctgatagccttgtttttctggaatggctttgcaatctctgctagcaagcatagcgggtgccccaaccttctccctgaagaggaggatgctgttagccagtaacaatctggcttgccttgggaatgcattagcttttgatttttgtgcttactgcacaaagaggtactgtgtaattattctttctggtgatccagtcgctcaatagatgcccattaactagagattatacatgattggattttcccttttgaagctcccacctaatggctaaatggaaacttaatgagaaggggaagtgggctagttgtgctctgaaaagagtaacaactcatttatggatagcagtctctctaaattccttccaaaacctaaaattataagactggggtataaaatttaaacaacatttgtctcatagtattattcaaaaggatattatagatctatttaaggtatcagtgttttacaagatcctgtttgttgtctttagggaataagcctctctcaaattttccctatttttcctttatgttctacaagtcctaaaatgtttggactatttatacagtatttccaaacaatccatttgaaaataccaatgtaggtaatgatgtaagaatcaccactgaacactagctgctctacaggtcacaaaactggctctgatcaggaatgcagtatgatggagtaggaaagtcaaaggctttgaagccaaagagaagttggattcctgatttggtcactcattctgtgtgtgtgtgtgtgtgtgtgtgtgtgtgtgtgtgtgagcctgagcaagttcttttaccatgggaacaaatacaaacacacagagttgttgtggggatggagactgccctacacaatgcttagtgcataatgggtattccaaaaaacattacttcactctccgatttgaagatgctacttttcactgtggcattattcacaacagcaaagacttggaaccaacccaaatgtccatcaatgatagactagattaagaaaatgtggcacatacacaccacggaatactatgcagccataaagaaggatgagttcatgtcctttgtagggacatggatgaagctggaaaccatcattctcagcaaactatcgcaaggacaaaaaaacaaacactgcatgttctcactcataggtaggaattgaacaatgagaacactggagacacaggaaggggaacatcacacactggggcctgtcgtggggtggggggaggtggggggatagcattaggagatatacctaatgtaaatgacgagttaatgggtggagcataccaacatggcacatgtatacatatgtaacaaacctgcacattgtgcacatgtaccctagaacttaaagtataatttaaaaaaaaaatgagaaaaaaaaaaaaaaagatgctacttttcccctgtgttatcttcttatgcttttctaatttcagagattttgacaggatgctccagatggccgcctatggggaaaacctgactttctcagtaaaatcttataaaccccacagcatcaaggtccacaatgagggagagggacaggagggtggggctctatgtgaaaatcaaccatgagctagagaggaaggcagtgtgtccaagagtccaaaacaggactggagtggtgaaagcagtaagtaattctgaatgggatgaagaacaaggaaacaaaggtagtatttatggaggtctctccatgtaatcttttcattgctatcttgaagggacctaagagtttaaagcaagcaggtttcctcaggggaataaagaaagggggagcagtgactcagtacagcatcccctgagtttggtagttacaaagccgtcttgcaaggccacaatgtctgggttctaagagtggtaaggagaacaaatggctggaaacatgaaaggtggagcacggaaaggaatgaggaattaagtggaagagagatgggaagtcagtccccaccccatgtctccaggtactgcagaggaaacatatgagggatgtatatatggttttgttttgttttctgttttttgtggggtttttttgttttgttttgttttttaaatacggagtcttgctctgtcgccaggctggagtgcaacggtgtgatctcaaatcactgcaacttccacctcccggcttcaagcgattctcccgcctcagcctcccaagtagctgggactacgggcacacaccaccatgcccagctaatttttgtatttttagtagagacagggtttcaccatgttggccaggatggtctcgatctcttgaactcgtgatctgcccgcctcagcctcccacagtgttgggattacaggcatgagccactgcacccagccaagagatgtatatatgttttaaactaaaagcttttgaaatataggagccagaatcctccagagctattgtgacctaaaccaccttaatattttctttacttaagatggaaacacaagaaatgtcagacttccctgtacactatacatgaaacaactcttcacagtgagaaaatttcactcttcatttattccaaaacagagaaatgatgtttacttatatggttgataaggaaacaaccccctgaagaaaatagcagctattgccttaaggcttcataaagaaggctagacatacaatttaataaaattgtttttaataaaaccatgggggctgcaatagttctcccatcctacatacttttccacttcttttataaaggtttcagaagacaccaaagggaaaatgctgctctcaagttacactgaccagaggatccagaggattccaggcaatgcaaaagatgtctggagaaaaaagcatccaagagtctaattaggtttagaaattagagaaatgctatacacatccttgcactctagactcactctgtgtgtgtgtgtgtgtgtgtgtgtgtgtgtgtaaatatatatattcaattcagagatatattttatatatatgtctctcagaagttacaatacactccattaagatacaaaaggttctataatatactattattttaaaattaggttaaattcatttaatccaactttcccaagtttgttggacatggacagcccccattttataataatatctattaataatagctcagcacatattggcaaacactggactagagcaacagcctggcgtaattccttcctctctcttcaccaaatacttttgggagacaaaggaaacacccactttgttaaatacaatacagtcctctcctattccccatcatctttctcagcctgctacaggttgagcatcccacatgcaaaaatcctaattccaaaagtataatacagatattctaaaatctgtacatttccaaaatcagaaacacttttggtcccaagcagataagggatactcaatccgtacacagggtcgcaggaataagtggtgatggcaaaaatagaaaattctcttatggaagctataatttttttaatcactttgaattttattccttaaaggcaagagacaaaaggtcacaggttcaagggtgaggtaagaaaaaacaatgagcttcccaagagaaaagaaaggtcatttcctatatccaaactctcatgtgaaaccatggccaatctgagagttgaaatcctctttaagtctccaacacttatgagaaggaaaagttatttgaaataccaaccagtttactttctacccttctcatcatttccttcctcttatgtctaccaaggagcatcacacgtaaatagattacaatgcagaccctcctattattctgatactactaccaatcaaagatataacctaggaagaagaagctagactctcaggcagatcaattttagtactattaccattttgagatggatatttctttgttgtggggctgctgtgtgcattatagaaggttagcagcatccttggccagtgcctgtgccaggagcattccacaccctctgaactgtgagaatcaaaaatgtctccagatcgccaaatgtcccagggaagggggctaaatcactctctccacttgaaaaccagtgctctagggatgtgggctcctaaacttgacaccgtgggagaatatactaaggcactaccatctcaggcctggcccttctttctccttagccatctttccttggcccgtgtgacagtctgtgatgctattcacatacatcctgacctcgccatggtagggtaattcacgaagtatgttgatatctaaattcagggctacgtcctgcttgccattaaattcatatttggaaaaccatggttatcagtggttctttactagaggtccatggacttggggcatgaatgaggactataaataacaggaagccatatatatacagctgatcatggagcagatggagcctaggcatacgttttcctttcaagttctccaagtaattctgatctatctctgctcaaaaatcattgctatggcaaaatgatgcagcccatgtggtagcaccaacctaagtaaggaagctgcactgatggtatcatgacagactccatcccaatatgtgatatttcataactaccaaataccacaatactctaacgcctgttcctgggtgtcttttacaaggaaaaattatgaaaccagtcattcactggatattaaaaacatgaccaactatataccttatcaagtagctccaaagaagaatagagaaaataattgttatttaatgattgcctatgatggtcaggcattgtgatagaaactttatataaattacctttaatgatgaccttgtatgatagcacctatatcctgttttacacattgggggaaccatagctcagaaatgttacacaacttgccttgggttacacatcaaaaagtaccaagattcaaagctagactctgtaagacactaccttcccagttagactgcatatatattatagctatttgcagcacaatgaagatcctaatcttgtttcaaagacactcttcccaccatcacaaagaaaacacaggctgggcgcagtggctcatgcctgtaatcccagcactttgggaggctgaagtgggcggatcacttgaagccaggagttcgagaccatcctggccaacatggtgaaaccccatctctactaaaaatacaaaaattagccaggcatggtggcacatgcctgtagtctcagctacttgctacttgggaggctgaggcagaagaatctcttgaacccaggaggcagaggttgcagtgagcgaagatcgcaccactgcactccagtctgggcaacagagcgagactctgtctcaaaaaacaaaaaaaaagaaaagaagagaaaacacaggcacagttactctgtcttcataaactgaattctgaacataagtggaagtagcgtaagcttccattctagggatgactggtttggatggtgtctggttagttcatttagtcaggtctccattatcctcagagtcagatttggaaacttcatgccaactgatcacagatatgttcggtgaaggaggatgggaagcataatcaaattccacaccgctatttaaaaaaaaaaaaaaaaaaccctgaagggctgggcacagtggatttactcctgtaaatcccagcactttggaggccgagggaggaggactgcctgaggcgaggagtttgagaccatcctgcacaacacagtgagactctatctcttaaaaaaatttaaaaataagccaagcctcgtaactattcaggaggccaaggcaagaggatctcagaagtttgaggcttcaataagctaagatcatgccaatgcactccagcccgggcaacagagcaagcttcatctctataaaaaagcaataatactaataaacaaaataaaaaataactgaaaatacatatagtgtgtttttttaatatgataaacagattagcaaaagtaactttcctttttatctgtgcattttcatgaacatggcgaccccaatgcaaaaagtcttcgccctgggaaacgaatgcattctaggtagccgagatgtaaattacatttctgaaactgaattctatataaaaccaaacaaaacctgagaaagtggaccccattgcatcatcattctaaaacaaacaaacaaaaaaatcccacaatattgtgacttgaaaacttgtcaagatgttttcatcaactgggtaatttagtacagcaatactgtgtctgctatggaatctcagctaccacttagaattcattctttcttcagagcatttcaataatcctagaatctcttctgtacattcccccttctctctttcataccaatcaacggaagtggtaggctggttccaatgacctagcctccagtttcatttagtttatgtataggtacaacaggctcttagcagtgatatatgtttaacataggagccacgaactgacacagaatatatttcaattggaaaactctctactttgagaattatatgaggaatcaatttcctgctttaaaaatgctgcaaattctgcattaagtaattaacagttaagagtcacacagctagtaaatgagagacacaggattcagacctaagcctgttctactcagaaatcaatgtactttccacacagaaaaatgtgtcttaggtgttttccaactgctggttttggcctatgaaatcaatttaatagactgcaagcagaatgttttaataaaacaaagctgaattgagaagatcccctacacacaaaggtaagcaaaataacaaattcatataaaaaagcctaaaagaaatgagcaaaaacatagaaaaattcaaattaaaaggaaagcaagggtctttattgcaaggagagcaatatttacattttaaatctctgaaaagcaagattcaaaaagaagagtgctttttaagagtcagggttccactttgtcacccaggctgaagtacagaggcatgatcatagctcactacaacctcgaactcctgggctcaagcaatcttcccaccttagcctcctgagtagctaggactacaggttcacatcataacacccaactaattttttaaaatttttcagagacagggtcttgctatgttgctcaagctgatctcaaactcccaggctcaagtgatcctcctgtctcagcttcccaagtcactgggattacaggtaagtcaccacaccaagcaacagtacataaaggggaaaagttggaaacaaacaaacaagggagggagggagggagggagggaggggcttgatttactagatatatctcaaactttctacccaataagagactacatattattctcaattttccatggagcattttgtaaaaactgatataggtcacagaagaaaattccaaatatagttagaaatcaggaacagattattacatatttaagattaggccaagtagaaaaatctaaatatattccgccaattattacttgctataaattccaaagataaatacatagaacaatgactggtaaaggcaaaccaaacagcttttcattgttcttgttacctacacgtaggcccctaaaacccaaatcttgccaacacattgctgggaattaaaatcactagaaagccagaagtattcattttgaaaaagaagagataaatttgtctaaaatagcagttcctatctctcaaacaaacaaggcaattcagaaggaagaaggccatatgtgctcatacattaacacaaccaccatcaaacagcttgactggaaatcttctcccctctccggacaaacactaaaatataggaatataccagttattttctttctgccatctcataaaaatgtaaaccactaataaattttaaatccattaggagtttggttgaaatttgttatatggattattataatacagtaagttctcttctaattaatctaaactgtagttccactcaaatttgtaacaagtatttcattgttattgacattatacgacaagaaatgataccaaaaataccttaaagaatgaatgtggacgaatgtttttcttctttttgtcatcaccaatcgtgtgtgtgcgtgtgtgtgtgtgtgcgtgtgtgtgtgtgacagagtcatgctctgctgcccaggctagagtgcagtggcacaatcccagctcactgcaacctctgcctccgcggttcaagcaatactcgtgcctcagcctcccatgtagctgggactacaggcgtgcaccaccatgcccggctaattttgtatttttaatagagatggggtttcgtcatgttggccaggctagtctcgaactcctggcctcaaatgatctgcccgcctcagcctcccaaagtgctgggattacaggctgagtcaccacacccagcctggataacaaagcttttaatcaatttttagttagactttttcttactgatttctagaaattctatatatattctagaatgaactcctttctcaaatatattattacaaaggtcttctctcaatctgtggcttaacttttcattctcttaatggtgtcttttgataaacagaagtaataaagtttaatgaagtttaatttgtcaattgtttcctttcttatttatgctgtcatcttgctcaagaaatcttttttcttctaacgtcataaagatattcttccacacctaggttttattttaccttgtacattttcatttaaaattcatctttactgatttttaagtaaagcagaaattaagattcatatttttaaattttaagtccatgtttttccaactggagactgcaatccattatagtttaaaatatcaatttaagggataaccagcattttttttaaaactgaaatagaatagagcacatattatatcctctacttcatcaattctaagatgtatttttttttttcacattttaacgtctctgaaatagagatgtttcttataatcaatatcttacaattaaaaatggcggcaattttcctgactatacagacataacacatacacacgtgatagcagcagaaggcagacaaaatcctaggcagacaggggagggtccgcggtgaaaccccaccttttttttttttttttttttttttttttttttttgagacagagtcttgctctgttgcccaggctggagtgctgtggcacgatctcagctcactgcaacctccgcctcctgggttcaagcaattccctgcctcagcctcccgagtagctgggactacaggcacccgccacgacacccaactatttttgtatttttagtagagatggagtttcaccatgttggccaggctggtcttgaactcctgacctcgtgatccacccacatcggcctcccaaagtgctgggattacaggaatgagccactgcacccagccaaaaccccaccttcaagctaaaaacagcctgaagcctgaagacaaggctgctggttctggatgaagcccacgacccagagtgagaatttctattcctgtttgccagctctttcccaattgtttctttctggataatgccttttaatcaaacattgccttttccaatgctacttactgcccgcacctctcccattctgtgactattaaaaaccctgaactcagccacactgggggactatgcccattttgagtgccctctccgctgagaactgttttgtcgctcaataaaactttccgccctgctcaccctctggttgtgagcataacctcattcttcttggatgcgggacaagaactcaggacctaccgaacatgggtaggtaaaacgctgtaatactgtagccctccaccctctgccggtgccaggcagcagccccgcatgacaggaagcagccacggggccaggccagcccaggagccgtgggccagagcagggcgacaggattaaatgagctgtaacataagtgggctgaaacacgtcccacccccccacccccgctgattggtagtgctgcagagaggagagaagagctacaacccttctggggccccagacctcgccactcccagagccagagttgcgacatgctgtaacaccctctttggggtcacgcggatgctggtgtctccaaaagtttcaagtgccaccgcattcccccttgtctagatgccggtgcccaaggcagaagcaggctacagcacgcctggccccggcacagactgagtgcgggatcagggccagggcgctaagagcagcccaccaggccaagtgggcaagatacctccaacagcaagcccagggcggagcgcggccctgggcaggggcactgccagctgcaaagtctccagctggcgaagcagcacagaaaacatcctgcatcacatgcatatatataaaaattaccacacacacactaggtataaacataaatttcatttcttacattgaaaacccctgaaaaaccctgctaaaggttagcagagtataataaatcccatactaaaagttactaccttttcagtttgctttcaattctaatttcatcaaaagatattttcacacctctctaatatctgccatcacctgtttttaacaaaaagagccaggctactgttcaattttctgtaaaaaacaaacaaacaaacaaacaaaaaaaacagtatctggctaaaacgtcatatgggtttttggtttttcgttttgttttattttgtttgagacaaagtcttgtcctgtcactcaggctatagtgcagtggcatgatcatggttcactacagcctcagtctcctgagctcaagcaatcttccagcctcagcctcccaagtagctgggaccacaggtgcatgccaccgtgcctggctaatttttttatttttcttttatggagacaagatctcagtatgttgcccaggttggggttttttaatggtatttacttttacactaatctacgccagtaagcaccactgattttccagtcatgtagtgattacagttcccttttctgatttactttacaaagtagatttttaaaacatggtcagcaggtaaaagaacaaatggtgtgcagacatgtcaaaaattgtgaggtttgtactcaaactgcccaaagtcagggaaacactattttagaagaacaatgataggggaaaaggcctaaactattttaagtgggaaaaaagcaagtcacaatatatctgtacaatctcatctttacaaataaaatttattttactatttacaaaagcaaccatgtgcttacaatattatctctgtaatttttatttgatttttgcttacttatcctacctaaattttccttaaagtacacacgtatctttttaacagcaaggaaaagtgattttgaagttaaactttaaaagtaagtaaaagattcacaccaagaccccagatatatatgctgtggtctagggaaacagaaactcttactgaaaggtccagcagtgctgtattccacttgacctctctgtgcctatgtcctcatccacaaaactgaggtgaaaacagggcctccctggcagagtaagtgagaaaattttaagagataatcctggcacccaagcagggctctgacacagtttgcatctgtgtccccacccaaacctcttgtcaaattgtaatccccattgttgaaggtgaggcctggtgggaggtgactgaatcatgggagcggtttctcatggtttaacaccaacccccttggtgctgtcgtggcatgagtgagtgagttctcacgagacctgattgtttaaaagtagcacctcaccactctctcttcctcctgctccggccacacgaagtgcccgcttccccttcgccttctgccataattgaagccaagcagacgctgccatgcttcctatatagcctgcagaaccatgagccaattaaaccccatttccttatcaattacccaatctcaggtatttctttatagcagtgtgagaacagactaatagaggctcctttagtcaaatttaacttccataaggcagagatatttggttgtattattcaatctgtatccttagcacttagaataattcccagcatactacttaagtacagaggtataataaatatctattgataaatattagctacacacttcagtgcagtgggaaaagaatggtcttttaaataaaagactctatcaactagatattcttaacatattttgggccctaccctctcacatgcatacaaagaaatacaaaaaaaaatccattctagatagactgaagatctaagtgtaaaagacaaagcagtaaagcttttagaagaagccataggacatcctcaagacctgggaataggcaaaacttttttaaacaatacacaactgctaaccacaaagaacaatgtaataaatcagactatattaaaataatttctgttcattgaaaacattcagagattgaaaatgcttgaaaactgatttatggtgatgatgcatcactggactacatatgtggattagttttgtgatatgcaaaatataccacaatatacctcaattctttcaaaggaactagatgtagaagaaaaaaggcaacttacagagcaagaaaagagtggcaatacacacagaattttttttaactcacttcaaaccaaggaagaatcacaatcacacacatactaaatttttaaatgagcaaaagacttccacaggcacatcacaaaagaaaatacacaaatgaagtttttttaaaaaggaaaaatcaaccaaaatactgccacctagggatgaccactggaccattttggtacacagactgaaaactgcatatatgtaagtgaaaattgtttaaaacatgctcttcggttaactgttttttccatgtgtcatgcacatctttccacatcattgtagttctacgttttcatttttaagggctacagttcacttcatcccataatttccttactcaatacaagtagtaacaaacattacattttttactattaaacacaacactgtaatgaaccttcatgcctactctgacaattacctcttggtcaaatttagaaatccatgagatccaaaaggatggctgaactgaatttcctttgcgaattccttgactaataatcatttgttttcatcagaaaagacttcatactacaagttattaaatctaagggtcaattcttattcctcctatttcttcaccgatcagcaaggttgagcacttccatcttcttgatatacttcattcacttggcttccaggactctgatctaattctcaaaccttcactacaagaaacgttaaagttcttcagacaaaaagaaaagaaaaattggatatagtaaaggaatgaagacataactgaaaagaaaaatagtaaaaatgagagtgcatatacattaatttcttttctttaaatttatagaaaatatgactaactgaaaagtataaaatattgcagaaaaaatcaaagagacaaataatagaaaacacaattcatgttcatggattgcaagacttaatattaagatcttcgtaccacccaaaactatctacagatttaatgcaatccctaaaaaaacccaacgatgttttttgcgtaagtagcaaaatcaaccataaaattcattagcaatctcaagggactcagaacagacaacataatcttgaaacacaagaattaaactggacttcaatcagctttgaaaagctggtttcaaaatttactacaaagctattgtaaccaaaactgtggaactagcatgaagacatatgtatagaccaacgggacagaatggaagattgtaatcggtgcatttcaagcatttgacaatattcaacatctattcatgcttaaaaacactcagataacttcctcaatatgataaaggtcatataatgaaacatcatcatacttaatgtttaaagatggaacattttccccttgtcctgaaggacaaagctagaatatccattcacacttctagtgtgaattcaaatttgtgaatttgagccgggcacagtggctcacacctgtaatcccagcactttgggaggccaaggcaggcagatcacttgaggtcaggagttcaagaccagcctggccaatgcagtcaacccccgtctctactaaaaatacaaaaattagctgggcatagtggcatgtgcctgtaatcccagctacttgggaagcagaggcaggagaatcacttgaacctgggagatggaggctgcagtgagctgaggtcgtgccactgcactccagcctgggtgacagagcaagctccatctaaaaaaaaaataaaaaataggctgggcagtggctcaagtctgtaatcccagcactttaggaggccaaggtgggtggatcatttgaggtcaggagttcaagaccagcctggcaacatggtaaaaccccatctctactaaaaatatttaaaaaatgagccagtgtggtggcacgcgcctctaattccagctactcaggagctgaggcacaagaatcacttgaaccctcaaggaggaggttacagtgagccaagatcgcaccactgcactacagcctgggtgacagagtgagacctgtctcaaaaaaaaataataataaaccaatcaataatttaaaaaattgaaaattcgtgaacttgaaattgaaaatcacaagtttcactatagtcaatgcaacagagcaagaaaaagaaataaaaacataaataacaaaaagaatgtagatggtatgactgtctaactagaaaatcctgctgaatctacaaaataaaagtgatgggatggccgggcgtggtggctcaggcctgtaatcctagcactttgggaggccgaggtgggcagatcacgaggtcaggagatcgagaccatcctggctaatgtggtgaaaccccatctctactaaaaatacaaaaaaattagccgggcatggtggcaggcgcctgtagtcccagctactcgggaggctgaggcaggagaatggcatgaacccgggaggcggaggttgcagagagccaagatcgcaccactgcgctccagcctaggcgagagagcgagactctgtctcaaaaataaaacataaaaataaaaattaaaaaataaaagtgatgggatattagtgaattcacaggacacaaagactgacaaaaaaaatgaagctacgtaaagctcaagctctcagtataactaaaaggcacagaacataagtagaaatttaaatcctagtacatccttatgctccagccataaatcttcatgaagatcaagggcagttcaggaaaactgtgcagaataaaaaaagaaggaaacgagcagcagataaaagattgacataaaatcacattatgtatgaaaatacttaaaaagcgtcctgctagttcagagttgattacagataaagaggatgcaagatgcaaaaaggcagtcttcaaaagatcagtttttaggagaaaggagtgtacaaacaaaaggcaaatagaggagaatttcctcaacgtgataaagaacacctgcaaaaaacctacagctaacatcatacgtattagtgaaaaagttgacaccttcccactaaaatcaggaacaaggtaagaatgttccctctcaacactggttttcaacatcatcctctaagttctagctaatgcaataagacaaggaaaggaaataaaaaatatacagattgagaagaaagaaaactgttttggttcacaggtgacatgattgtctatgtagaaaaactgaaagaattgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaataaataaaaaataaaaaataaaaaataaaaaaataaaaaaaaaaaaaagaaaaactgaaagaattaacaaaacagcccctggaactcataagtgattatggcagatctgcagtatacacagtttatatacaaaaagtcaatcactttcctatataccagcaatgagcaaatgaaatgtgaaattaaaaacatattaccatttacataaacacctatagatataattaggtataaatctaacaatatacacaagatatctgtaaggaaaactagaaaatcctgatgaaggaaatcaaagaactaaattaatgaagagatattccatgttcatggaaaggaagattcaataaggtcaagacatcagttcttcccaactggatctatagattcaatacaatctctatcaaaatccagcaagttactttgtggatattgaaatgactctaaggtttacatggagaggctaaaaaaaataaataattcaaaataaataaataataacaaacacaactgaaggagaacaaagttcaaggaatgatactgtctgacttcaaaaggcactacaaaactacagtattcacgaaagtgaaagtgtggtactggcaacagaatacagagctaggtcaatggaatagaactgagggcccacacaatagacccacacaaatacagtcaactcatctttgactgtggagcaaagtcaatacgatgaagagtctcatcaacaaatggacatctatatgcaaaaaaaatgaatctagacactcagcttacacatttcacaaaaattaactgaatacagattacaagcctaaatggaaaatggaaagctctaaaactcctaaaagataacataggagaaaatctagatgatcttaggtttgttgattactttcttagacatatcaaaggcacaatccatgaagaattattaagctggacttcattaaaaataaaaatctctgagagacactgtcaagagaattgaaaaaatatgccacaaactcagagaaaatatttgcaaaaaacatatatgacaaaggactgttatccaaaatacagaaacaatttctctctctctctctcctctctctctctctctctctccctccctccctccctccctccctccctctctctctctctctctctctctctctctctctcacagggtctcactctgtcacccacaatgcagtgcagtgatgcaatcaccactcactgcagcctcaacctcccaggctcaagtgatcctcccacctcagcctccagagtagctgcgaccacaggggtacaccaccatacgtggctaatttttgtatattttgtggagatgaggtcttgccatgttgcccaagctggtctcgaacttctgggctcaactaatccatctgcctcagcctcccaaagtgctgggattataggtgtgagccaccatgcctggcctagaaacaattcttcaaactcaacaagaaaaaagtaaacaacacaatttttaaaatgggccaaaaaccttaacagtcacttcaccagaaaagatatacagatgacaaataaacatggaatatggagcatctcttcataagtcatcaggtaaatacaaattaaaacaaaataccacaacacatctatcagcatggccaaaatccaaaatgcaaacaccatgaaatgctggagaagatgtggagctataggaactctcattcattgctggtagaaatatcaaatagtaaggccactttattttttttaatttgtacaaatttatggggtagatgtgaaattctgttacatgtatataatgtgtagtgatgaagtcaaggtatttagggttcccatcaccaaagtacaacacatttttgtaactatattcaccctactctggtgcagtcactttggaagacaatttggcagtttcttacaaaactatatatactcttgcccaacaatctaatattcatcctcttttttacttgtccaaatgaagtgaaaactaatatccacagaaaaaccttaacatggctgtttatagcagcagttacacataactgctaaaacttggaagcagccaaaatgttcttcaataggtgaatgaataaactgtggtagggccaggcacagtggctcatgcatgtaatcccagcactttgggaggccaaggcaggagactctccagcccaggacttgagaccagactgaacaacatagggagactctgcctctaccaaaaaaaaaaaaaaaaaaaaaaaaaatttagtcaggcaaggtagaatgcacctgttgttccagctacttgtgaggctgaggtgggaggattgcttaagcccaggaggttgaggcttcagtgagccacaatcacaccattgcactccagcctgggaaacaaagcaagaccttctctcaaaaaaaaaaaaaaaaaaaaaaaagtgtggtacatccagacaattgaatgtcatccaatgaaatgaggcatcaagtcatcaaaaaacctggtggaaacttaaacatctattattaagtgaaagaagccaatatgaaaaggctacacaccgtgtgatccaactagatgacattctgggaaaggcaaaactatggagacattaaaacaattagtgattgtcaggaaggatggataggaagcacacatagaattcttagggcagtgaaactattctgtatgatactgcaatgatggaaacatgttattatatctgtccaaacccaaagaatgtacaacaccaagaataaatcctaatataagctatggacttcgggtgataatggtgtgtcaaggtaggctcatccattgcatcaaatgtatccctgtggtatgggatgcccacattgtaagaggttgtgtgtgtatgtgggtagaagggatcctagaatcccaggaggaagtattctaggatcctgcaagaaaagaatttttaataacatccaaaggatacaaagcctttcctcccaccatcacctgcttatcctgcaaaggaagccatgcagtaaagaaataatactttgataaggaatgctcttaagctaggaatcttatcaacttaaactacctcaaactgccaggtctgtctcaaaaaaatgtagagacacatgcaattttcatctatttaaaaaaaaaactatacagggaaaagttcattaaactcctacatataaaagaagaggcagggagtaagggaaggagggaaaaacagagagaactaaacaacatcccaaacaagcctttcttaactaaggttctgtgagatcatgaagcccttatgagagtaattttgcagacagttttcttaatttccctaaggatggtacatagataataccattcctgtcatgtatgagagacattaattcactatatacaatgtatgccttagtgcgtaagcgcatactgtttttgagaaacctggttgaaaagagctactgcaaactgatttaaatatgatcaaacaggcatgtgatgttacttaaaaacactctgaaacactgaatcagaaattgaaaacttaagacagaaatgtaccaaaaaccagaagaaatgtaataagaattgacctaactcaaaaaataaaaacaaaattataacaaacaagaatacattaaaatacccccaaaacagataaagcaaatgaaaattttaaaaatttgaaaagtaggttgggcacattgcctcatgccttgtaatcccagcactttgggggccgaggcatgcagatcacttgaggccagggttcaagaccagcctgggtaaaatggtgaaaccccaactccactaaaaatacaaaaattagccaggtgtggtggtgcacacctgaagttacagctacttgggaggctgaggcacaagaattgcttgaacccgggaggcagaggttgcagcgagccaagatagcgccaccctactccagcctgggtgacagagtgtgaccctgtctcaaaaaaaaaaaaaaaaaatagaaaattattaggaaacattgaagacaagcaagaaaacaacccaagagaataaaaatgagatgaagaaataagcaatatgggcagtgagaaagtagttaacatggaaaacaaaggagatccaacctaaatataattggagtttctaaagaaaaaaataaaataaaaataacctttaaaactataatccaagcggttcctagggttggatgggtgagggatatagggaatgacagcctaagggtacagtggttttttttgtttgttttttgttttgtttttgagacggagtctcgctctgtagcccaggctggagtgctgtggcttgatctcactgcaagctccgcctcctgggttcatgctattctcccgcctcagactcccgagcagctgggactacaggcgcctgccaccacgcctggctaattttgtttttgtatttttagtagagacggggtttcaccgtgttagccaggacggtcttgatctcctgacctcgtgatctgcccacctcggcctcccaaagtgctgggattacaggcgtgagccaccgcgcccagccggtagcgtgtttcttttggtggtgatacaaatgttctaaactgactgtggcactggttatacaactctgtgactatactaaaaatcactgaattgtacactttaaatgtgtaaatttacaatatttgagttatgtctcaataaagctgttatttaaaaagaaaaaaaaacgataattcaaaaagctttccagagataaaaggaaacctgaactacatgttgaaaggggctccaggtaataggggaaactggcccacagcaataaactccaagagatatcctaagacaattgttagactttaaaaataaagaaaaaatgttttcaatccccaccccaaattttttttttaatttaagaagaaacctttaaagagaaagagcattaattggattggcatcaaacttctcgaaacaacacaccaagcaaggcatcagtggagcagcatcttccaaaattttagaaaataaagggtaaaggtttccttgagtaatcctgagatgatgcaaaaaattgtcaaaaaaattaatggtaaacatttaaaacaattatggctctaagaataaacaagtctgagccaggtgttgtggctcgcacctgtaatctcagcactttgggaggccaaggcgggctgatcacctgaggtcaggagttcgagacaagcctgaccaatatggtgaacccccatctctactaaaaatacaaaaattagccaggcatggtggcgggtgcctgtagtcccagctactcgggaggctgagataggagaactgcttgaacctgggaggcagaggttgcagtgagccaagattgtgccactgcactctagcctgggcagcagagctagactccatctaaaaaaaaaaaaaaaaaaaaaaagaataaaacaagtctgaagataacagaagaatcacatgtcatattcagacaaagaaataacacaactttaaaactgcaggccaggtgcagtagctcatgcctgtaatcccaacactttgggaaggcaagatgggaggatcccatgagccaaggagttcaagaccagctaggcaacacagcaagacccatctcttaaaaaaatttaaaaattagccagatgtggtagcccgcacctgtagtcccagtgacttggtaggctgaggcgggcggccccaatcacttgagcccaggagtttgaggctacactgaattatgatcatgctactgcactccagcctgggcaacatagtgagagcctgtctcaccaaaaaaaaaaaaaaaaacaggaaatagaggcattacaaaaattataattaaaactaacaaaaatacaaacctctctataaaaagaaatttcaaaaataaaagagcaaagaaagcacatcatgaacagaaacaaactaaaagaaatgcagagagacatggatataaatacactatacacactactctcactacaagacagctcaagaaaacaaaaaataaaaattcataagcatcagtaaggcaggcaggtcttacaggatatgataacctgtttacacagactaaacttgcttttccagcacgtgtaaaaaatttctgaaagcttatcatatattagatcacaaagaaataagttcaataaaaaagaaaaattagaaaataagagcctctgatcaaaagataataaaactaaaagcaattcctagaaaaagaagaacaattccttcaatcaatgttatggaacaatttatagagcttctggcccatttgttctttaaaggtctggtggaattctctgtgaatccacactgacctgatacatttttctgatttaattctttgacaggtttctctattcttttcttcataactattgttggataagagaactcaacattcgaaagatgacagttctccctaatttataagtttaacatttccccaataaccccacaagaaaattctttatggagctagacaaaatgatactcaagttcatattcaaaagcaaacttacatgagtattcagtaaaaaatacaaaaaaagaaaagtggggaatcagtcctaccagacatcaaaatacaccataaataagcctctctactgaaaagcaagatactttcatagcacatgaatacacaaatactccagagtagggttggcaagctttttctgtaaagggtcagatgtaaatattttgagctttgcaggactcactgattttgtcacaactactcaactcttctgttataggatgaaagcagccacagatgatatgtaagtgaatgagtgtggctgtgctccaataaaactttatttataaaaacgcagtgggggccggatacagtggctcacacctgtaatcccagcattttgggaggccaaaatcattgagctcaggagttcaagaccagcctgatcaacatggtgaaaccccgcctctactaaaaaatacaaaaattagccaggcatggtggcacacgcctgtagtcccagctacacagggggctgaggtaagaggatcacttgaacctgggaggttgaagctgcagtgaaccatgattgtgccactgtactccaacttaggtgagagaatgagaccttggctcaaaaaaaagcaaaaaaaaaaaaaaaaggaaaatttaaactagataaaaattttaaacttttgcacagcatttttattaactaccataaactaaaccttaaatgacaaactggaaaaaaaatttgcagcctatgtcacaaataaaagaactaatatccctaaaaatttctttaaattgagggaagtaaaaaaaacaccaaaatcccaataagaaaatgaggaaaagtcataatcaaactttgttttgttttgagacagtctcactctgtcgccaagcctgaagtgcagtggcacgatcatagctcactacagcctcactcttccagactcaagttatcctcccacctcagcttcccatggagctgggaccaaaggcacatgcatgccaccatgcccaggtaatttatttttatattttgtagagacagggtctccctatgttgcccaggctggtcttgaattcctgggctcaggcaatccccagcctcagcctcccaaatcactgcggttacaggcgtgagccactgcacctggccataaacagattttcaaaaaacataacatgacccttaaataggaaaagatgttcagatttactcataattaaagagatgcaaattaaagctacacatttctcacttaacatattggcaaatatgtagaattgataacacattcagtcaatgaagcagtgaggaaataggtgctcttgtgtatttctggtgggaaggcaaatgtgtcacaacccttttggaagaaaatttgttaatatttaacaaaactaattgtgcatttactttttgatcagcaattccacttacaggaattctccctgaagatacactaattcagtaacaatatgaaaatacatatatacaaggttattcagtcattgtttgtaatttcaaaaaaaatggaaacaacctacatgctcatacgaaagacactggctgaataaactatggcatatgaacacaacagagtactatgcagccataagaaagaataaggaaggcccctgttgactgatatagaataactttcagtatacacctttaggtgaaaaggcaaagtgcaaaagaatatatactgtatactaccttttgtgtaaaaaataagcaaagataggccaggcgcagtggctcacacctgtaatcccagcactttgggaagctgaggcaggtggatcacgaggtcaggagtttaagaccagcctggccaacatagtgaaacctcatctctactaaaaatacaaaaaaaaatagtggggcgtagtggcaggaacctgtaataccagctacttgagaggctgaggcaggagaatcacttgaacccgggaggcagaggttgcagtgagccaagaccatgccactgcactccagcatgggtgacagcaagactctgtctcaaaaataaataaaccaaaaataaacaaaaactgagaaagagagatgtaatacatcagcagaaacaaatgaataacataatcatacttaatggaagagggtgaaaacccacccaagtgactcttgaactcagtaatgggactacacagtcataaacattatttttaagaactataaagaaatccccaggcgtggtggctacacctgtaatcccagcactttgggaagccaaggcaggcagatcacttgagcctaggagttcaagaccagcctgtgcaacatgccaagaccccgtctctaagaaaaatgacaaaaattaacagggcatggtgacatgtgcctgtagtcccagctatttaggaggctgagtggggaggatcacttgatcccaggagtggaggctgcagtgagctgagatcgtgccaccgcactccaacctgggctacacagcaagaccctgtctcaaaaaaaaaaaaaaaaaaaaaagaaagaaagaaagaaaactgtaaagaatctttagtatggctagtgttagtacatgtatttttcagtgatgtttgcaaggcgtgtcatccctcagtgtcatcctcaggcatcagtttcaggatacacacactcttcccgctatggatatcaaaatcgactggtgctcaaattccttatataaagtggaatagtatttgcatgtaacctaagcacatcctctcatatactttaaatctctatagactacttataattccaaaaaaaagtaaaagctatgtaaatagttgttctactgtatttttatttgtattattttttactgttatattattatttttattggtttttctcccaaatattttcaatcctaggttgattgaatccatggaatgcggagggcccactgtaattctaaaactacttgatatgcattctggggttgagcaagtgagtaaatatattgtggaaaaccggagtcaggtttctcactgttagagaagcgagtactaaatatgaaaagggtttccttctggaaggctagaatgagatctgtgagactagactagaattggatatatcagtatggactcacagtttctaatacatagaacaaggagggaagtatttttatatagacaaaaaattatacatacatttcctaacacagttggctgagagggcctagaagcaatgacattccagtagcactaagcacacttgccacccagatctaataccattcctcagtgaaaggaaacaaggctcttcggagaaatggctggttccaaggctgagagtgggaaaatacaagataagcctggaacatgttgcaacagaaaataaggaagtacttaaacaattatgagaacagatcaaaaggatacagacaggctgggtgcggtggctcatgtctgtaatcccggcactttgggaggccaaggcaggcgaatcaagaggtcaggagttcgagaccagcctgaccaacacagtgaaaccccgtctgtactaaaaatacaaaaattagccaggcgtggtagcacacgcctataatcccactactcaggaggctgaggcaggagaatcccttgaacctgggagatggaggttgcagtgagccgagattgcaccactgcactccagcctggcgacagagcaagactccgtctcaaaaaaaaaaagatacagacgctgacctgaaaaggcacccactgcctaaactttaaacactctgaccatcgaaataaataatgataataaaagattaaaataacgtactgaataaaataggaaaatataggtgtatactgatagaataaatgaaaaactgaaattctgatgaaaacaggatatttgtggagtttcaaagtacctccccacccaatgcataattacaaagggaaaaagaataactttacaatgaagaaggcttgatagacatttccttactcaagtgatctaagtgatcaccattctgaatgagagaaatcaatattatgtactacctgagaggatgcaatgagaaaacagaaatcgcttttatgatattcatttaaactaaatctaaccataaggaaacaaaggacaaacctaaagtgacagactatgaaacagctggtctgtaatcttcagaagtgtcaaggtcgtggaagtcccgcaaagaccaaataactcttccagactgaaaaaaactaaagaagtgtgacaactaaaggcaatgcatcattctgaactgggtagctctgctataaaggaaattatcaggacctctgatgaaacttaaataagggctgagaattagttggcagtaacctgtcagtgctaatttaccgatttgattctcgtattatgactatgtagaacatcctcctttgtaggaaatacacagtaaaatattacagcatgagagaagcattcggtcagctttactttcaaattgagaaacaaaaggttctgtgtgttatactaataacttttctataagcttgagactgtctcaaaataaataaaaagcaatatttcaatggcttgtttacattaattattacctaacacttcaaactatgagctcatatccccaggaataaaggtgctaaaaatcctttgtgacttttaggttgggaaagacgcatgaacctgtagtgtcagtcagtgctagtttgagaatatttgttcattaagatcatgtgattaaaatgtggtggtaaaaaagtcacaaaggatttttagcacacttattcctggggatatgagctcatagtttgaagtgttaggtaataattaatgtaaacaagccattgaaatattgctttttatttattttgagatagtctcaagcttatagaaaagttattagtataacacacagaaccttttgtttctcaatttgaaagtaaagctgaccgaatgcttctctcatgctgtaatattttactgtgtatttcctacaaaggaggatgttctacatagtcataatacgagaatcaaatcggtaaattagcactgacaggttactgccaactaattctcagcccttatttaagtttcatcagaggtcctgataatttcctttatagcagagctacccagttcagaatgatgcattgcctttagttgtcacacttctttagtttttttcagtctggaagagttatttggtctttgcgggacttccacgaccttgacacttctgaagattacagaccagctgtttcacagtctgtcaatttaggtttgttctttgtttccttatggttagatttagtttaaatgaatatcataaaagcgattgctgttttctcattgctattgtgacagctaccacctgtaatcctaacactttgggaggccaaagcaggcagatcacttgggcccaggagtttaagaccagcctgggcaacacagtgaaaccccgtctctacaaaaaaatccaaaaacactagccaggcgtggtagcacacacctgtagtccagttgctcagaaggctgaggtaggacgatcacctgagcccaggaggttgaggctgcagtgggcagtgatcacaccaccgtactctggcctgggtgacagagtaaggccctatctcaaaaattaattaattaatcaattaaattttttaaatttaattaaaaataaattattatttttaaaaataaggggttcatccatctatctcttttctgtgaactctaccagatgccctgggcaatgtttcttttgacagtctttttctttcaaattaggtgacagtttcttcctatctactatcatcagagctaccattactttaaccctcaatttttcatttcttattgtcttaaagatgaaggatttaacatttgccttctactccaaattaagtaactaagatgcatcctgtaatgtaaagattttacagggatgccaataagtgactgttggttttctaaagagaggaaccttctttatattagggtagacagtgttcatatgcaatctgtctacaacaattggcagcttgttctctgcatgtaacataaggcatgggacatagtaggactcagaaccatggtacataaatatgtccaagatataagagtgattctgttttcttaagtagtttgtgagtaactccattctaagtgaatgatctgaattttgaaatctagttgtagcagccaggcaactcaatggcaggctgttgttaggtgtttggacatctcttgacatccttttcttggccaagcacagcagcacagatcttcttttttagtttttatttttagacagagtctcgctctgtcgccaggctggagtgcagtggtgggatctcagctcactgcaatctccacctcccaggttcaagcgattctcctgcctcagcctcccgagtagctgggattacaggcatgcgccaccacacccagctaatttttagtaaagacagggtttcaccaagtcggacaggatggtctcaatctcctgacctcatgatccgcccgcctcggcctcccaaagtgctgcgataacaggcgtgagccaccgggcatggcctagatcttgttttagtaggccatgccttagctgactcaacatatattcaaactgctcaggggaaagagttgccacttgtaaagaggtttgaatttagagcatgctactaaattatacagagcaacaggcttgctaaagcttttcaaaataaaaatgttcaatcctagtgaaggcataatgagacgtaaacactccgggaaacaatttgacaagatatatatgatgtatctcctggaaatatatcctagctaattcaaaatgaagccaaagatttacgcacaaagatggtgattagctttttggataattaagaataaagactctaagcacccaaagaaatgacaagttatggaaagttcataaaatatataagacaatgtcaaattatgctatgagaaattataggaatacattaatacactcattctattaagtatacaaagcatagaaagtaaaattatacatctatttatatgcatataataaattatatatataataatcccaactatgtaaaacatatgcatagatttaaaagtaaaagaaggccgggcgctgtggctcacacctgtaacccagcactttgggaggccaaggcaggtggatcacgaggtcaggagatcaagaccatcctggctaacatggtgaaaccccatctctactaaaaatacaaaaaattagccggacgaggtggcgggcgcctgtagtcccagctatgcgggaggctgaggcaggagaatggcgtgaaccccggcagggcggagcctgcagtgagcggagatcgcgccactgcactccagcctgggcgacagcgagactccatctcaaaaaaaaaaaaaaaaaaaacaactaaaagaaaacatgccaaaaatattaagaatggtactccataaactgtggtttctcatttttctttccacttttaccccaatggtctataataaatagtattaattttacaatcaaaagagaactttttaaagcaaaacaaaatacagtctgatttgaagactttcaaatcaaaatcagtttttttcaagataatctttcaactcacaggaatacttacattcacagaattcaaagaaagaagtccaaagtagtcctaactatgacagcaaataatattataccagataatcctaaccaagcttagaaatagcctttccttcacattccagcttattatgcttattcttcattcagtaaataattattgagcacctactacctgctgggactgttttagaaacagatgtgtttaccaagcagtgaaaaagaagacatgacccgttttctcatagaacttggattctggtgggggaaaagacaacagacaggaggaaaacaaacaaacatggaatataatttcatacagtgctaagcactatgaaggaaaaaaataaagcaacataaaataacagtggaaagcaggaagctattttcaattgggtggtcagaaaaggtctctctgaagaggagatatctgatcatgcaagctactggtataacaacataaatagcattcctattgcgtaattgacctgggatttagaaaagtctgtttacaacttaaaatataaaaatcatccctatgaaaatagtttctactttaagaggcagtaaggtataatagaactagaaagactaggtttgaatcgtggctccactacatagaaggtagatacccctgtttaggtcacaagctctctctccctcagttcagtttcctcacatataaaacagacagaatagtgcctagcttataaagtttataaagtgaagaaagataatatatgggaaagagcttagtaacatgtttaggcatgtagtactcattaactgtaagttccctacatacttatagttcttccacaaattgagcactatatactaatggttctctgcgaagcactcactatttcactattgcaagtagaaacgtatcacatttttatcttccaaccacaccgaggctccaaagtccaaatcaccgctgactaaattcttgttagatattgatgctataaatgatactggcttaacaagattaatattatttttactaacctcatactcaccttttctttcatttcatcatgaactgtttccattttgaatccctaactccaaagtgtggcctccttccaatctgcttgtgatggttaattttatgtgtcaacttggctagactaggttatatggccagttgtttggtcaaatactaatctattagcagatattggtgtaagggtattgttaggtatgattaacatttacaatcagtagactttgagtctattacccaccataatgtaggtaagcctcatccagtcaattgaaggcctaagagaaaagactggggtttcccagagaaggataaattttgcctccaggctgcaacagggaaatcttgcctgagcttccagcctaatggcctgtctcataacattcaatcttgccagcccccatggtcatgtgagtcagtttcctaaaatatctatctactattgattctgtttctctggagaaccctgactgacatgctgatcaatcttagagttggtctccctgcttccgcctcttctttctatgtctacacagcaggtagagggatcctgtcaagacattcaatgacccctctggtaaaaattctctaatgacttcccatctcatgcagaataaaagccaaagtctacgaaactctagaagccccacagaatttctatgaccttcctccttccttccctgatttcatctcctactactttctccctcattccacattccagccagacattagccttctggctattttaacatgccacaaacattcctacctctggggcttgttgtacacttgctgttccctctacctgggattcttttcctccagataactgcacagcttgctccctcatttccttcaagtctttgctcaaatggctttccctcttcgctctatttaaaactgaagcccttcccaaatcttggggtgctctattccccccttttctccacagaacatattactatctaacatcctgtgtactttactttttttttttttttttttttttttttgatacagagtctcactctgtcgcccaggctggagtgcagtggcgggatctcggctcactgcaacctccacctcccgggttcaagcaattttcctgcctcagcctcccaagtagatgggattgcaggtgcctgccaccacgcctggctaatttttgtatttttagtagagacagagttcaccatgttagccaggctggtcttgaactcctgccctcaagtgatctacctgccttggcctcccaaggtgctgggattacaggcgtgagccactgcacctggccgttttactcattttctttcaccactaaaatgtaggttctgagacaacaaggctttttgtctgttttgtgcactcctctattaccaggccctatgcctaacacatagtaagaacatcataagtcatttgttgcttgaagaaaaaacaaaagagtgaagactgatttttaatttactctttgtgttttcctatatttcccagttttctacattgggcatttatttctattataatcatacattgctgatgatattaaaaactagaataatgtttttgctagtagattaaaaggcttaaagtccagggctgggtgtggtggcccacgcctgtaatctcaggattttgcaaggccaaagcgggcagaccacttgagctcaggagttcaagaccccagtccggacaacatagggaggccccatctcaattattaaaaaaaaaaaaacaaggtccacttcctttgactcagaattttttcagtgaataagataatctaaggtatgaagcatgaatgtacactaaagtttaatgaccttaatgtccattaataagagactgattaaattattgtatacccagacaatgaaattgcagttattaaaaatgtaccagcctggggaacatagggagacgccatctctacaaaaaatttaaaaattagccaggagtggctggtgtgtgtctgtggtcccagctacttgggaggctgaggtgaaaggactacttgggcctgggaggtcgacgctatagtgagccatgttcacaccactgcactctagcttgggcaacagaatgagaccccgcctaaaaaaatagaaactttatttttaaaaataaaaatgtaggccaggcatggtggctcacacctataatcccagcactttgggaggccaaggtgggcggatcacggggtcaggagttcaagaccagcctggccaacagagtgaaaccccatctctactaaaaatacaaaaaattagctgggcatggtggcacgtgcctgtaatcccagctactagggaggctgaggcaggagaatcgcttgaatccgggaggcagaggttgcagtgagccaagatcatgccactgcacaccagcctgggcgacagagtgagactccaactcaaaaaaaaaaaaaaaaaaaactgggttatacttcagtgtatggagtataaacctatataaaaacaaaaagtatagatagataagcatatctatatagaaacaaaatgacagaaaacaaagaacagatattaaagtgaagtgagattatgattgactggttaatttcttcttcatgcttgtccactctctaaaatctctgccattaaaaaaaaagtgttactagccaggcatggtggctcatgcctataatctcagcactttgggaggtagaggcaggaagatcacttgagcccaggagttcgagaccagtctgggcaacataggaagatcccatttctatttaattaaaaaacaacaacaacaacaaaaatcaaacaaaaaaagttattttcataaacagaatgaacagtaaatataaaccaacagaaataaataaaccaagcactcttacaagcaacataataaatgtctatagtatcaggtacatgacatttttgttcaagaattaaaaagacgttttttaatgtgttctgaattccatttacccacgtccctatcctcaaattatactgtgaaaccttaatctatcatacacattgttttggaaaccataaattacaactgctagtaaggcaaggtatagttttcattctcccatagcacaggctctcttccaaagggaatgtgatttcttagtgctagtactatatgcaggcattgtgttatcattaaaactttctctaaaatattaatttatttgctgtttttcctgctgcttcaaattctcagatcaccaagtcatcctcactgttttcagaaaatatgacatggaaatttcaatgcataggaataacgtttgacactaaactttcaaagtccatatcatcagtaagacactttcaaactagtacaacatataaaagacagcatgatacagttgtggatgatgagcttacaaaggttgatggctgatgataataataggaaggtgaagaagaataaaagcttgaagaaggcttcggtgacttcacatcattggacacaaggaagtgaaacatgcgcatatgatatcaaatcaatgaaaaaacactagatcagtaaatagtatgcagacaactgataggtcattcagaaagaatgtgcatccctaattcacagcatataggaaaataaattacagagaaaatgaaagattgcaaagcacaatgctataaaccactagaagaatattataagaaaggaacaagtatagccacacaaaaagtaaacattttttcaaaactttcatcatggccaaaaccattattaaaaaactgaaaggcaaatgtcaaactgggagaagtatttgcaataaataacagttaatatatttaatatataaagagttcctataaatcagattttttaaataaggccatcattagaaaaatggaaaaaagaacatgaagaggtaactcatataacaaccacagaaatggccaatgaatatttttatgtatacatatattccaacccattagcaattaaatgtacattataacaagataccatttctgcattttcatccatcaaaatctcaacaaagtacaaaattaaaatattcaatgtcatctagagtatgaaaagggatctctgatgggctgcttttaagagtataattttacccagcttctcaaaagtacaagttagcaacctaaatgtgcacactgtcttacctaagaaaataatcacagaagtatacaaagacttaattacaatgatgcttaactccacatggcttaaaatgtctcaaaactggtagcagtcttaatatggaagggaagttttcttaaaatcattaatatatttattaaatggaatattatacaatgattttaaatgatgatagaaaatcttaattcatcatgttactatttgccagtttttatttattggtttaactttgaacaagtatgttatttttagtaatacttttaaagtacaccttaaacatttttaaatgatattcaggggttatggcaatgcttggaatataaatgggtctatcttccatgaaagcaatttagccatacctatcaaaataaagcactgttcactttaagataaatcactgagctgtacacacttaagatttttgaacttttctatatacactttatacttcaaaaatggaaagaaaaaaaaaaacacctgtactctcgcctccacccctaaaatctagggatgataaaagtaccattcatgaaagagttagactttactaatctggggacatgtctataacataatgttaaataaataaagcaaataagtgaccccgtattgtgatttttctagggtgagcccatttcctctattcaaaaaaaaatggctgggtgcggtggctcatgcctgtaatcccagcactttgggaggctgaggcgggcagaccacctgaggtcaggagttcgagaacagcctggccaacgtggcaaaatctcgtctccacttaaaatacaaaaaattagccaggcgtggtggcgcacacctgtcgtcccacctattcaggaggctgaggcaggaggatcacttgaacctgggaggcagaggctgcaatgagcccagatcatgccactacactctagcctgggtaacagagttagactcggtctcaaaaaaatacataaataaataatttttttttaatttaaatgagggaattctgatagttgtcagattgcataccctcctatgaacaaagaaaacaaatatacaatgataaagaacaaaatgttaacattcgtttcttagggggaaggaagggattagaagggagagattactaaacttttctgtatataatttaattaagtcataataaaatactgatattccttgaccaagcaattacacatacaaaatcgtacaagcctaaagatacatatgcaatgaaatcactgaagttcctataatacaacccccgccacaaaagacaaaaaaaaaattgtagtctaaaggcccctcaaaaggaaaactagccaccgggatcagtggctcacacctgtaatcccaacacttttgggaggctgaattgggaggatcacttgagaccagaagtttgagaccagcctgggcaatatatcaagaccctgtctgtacaaaaaactgaaaaattatctgggcgtggtggcacatgcctgtggtcccagctactcaggaggctgaagtgcgagggatcacttgagcttgggaggtcaaggttgcagtgagccatgatcctaccactgcactccagcctgggcaacagagcaagacccaatctcaaaaaaagagagagagaaaaaaagtggctatttttttttgaaaataaaaaaatgctaaagccctgtgatgtagcctcccgagtagctgagattacaggtgcatgccaccatacctggctaatttttgtatttttagtagagacggggtttcaccatgttggtgacctcaggtgatccatttgcctgggcctcccaaagtgctgggattacaggtgtgaaccatcatgcctggcctttatttttaatttcttgaagcttgtttaaaaattttttaatgctagcatgaaacagtggtttgtaaaactttgaggcattttaggtttgcttttaaaatgccccaagaaaaacaaaattgaagaaaagttgaactaagattagcataattttgaaaactgttcaagattaagttgaataattctcttatttttgtgtgtttagctatttctataaggagaaagtttttaaaatgaaatcttcctaagagccccattaagtagaatagataaatccagagccattctaagtgagatcgaagtaggaggcacactgtgctagcccctcctttatccctctagtgactccaaagtcaagctggggttccacagggcattaaaaataccactgttaaaatcagcagcagcagaataacactgcacaatttgatggattcctccctaccgaacagacaggaggaagtaaggccctaaaatagcaacaaatgttctctctgggtggtagatgctcacgctaccaatggacgttttcttctttttcaaagtctatttcgtaaattttcttataaagaggaaagatgtggttttttttaaccatatatacatacacatatatgtgtgtgtatatgtgtgtgtgtgttgtgtgtacatacatatatatatatatatatatatatatttttttttttttttttttttttgagacggagtctccctctgtcacccaggctggagtgcagtggtacaatctcggctcactgcagccgccacctcctgggttcaagcaattctcctgcctcagcctcccaagtagctaggattacaggcgcccatcatcatgcccagctactttttgtatttttagtagagacagggtttcaccatgttggccaggctggtcttgacctgacctcaagtgatccgcccacctcggcctcccaaattgctgggattactggcgtgagccaccgcgcccagcctatttatatattttttagagcaaacccgtggcctgcaggcccccaggacggctttgaatgaggcccaacacaaattcgtaaactttcttaaaatattatgagattttttttctttcgcaatttttttttttagctcatcagctatcgttagtgttagtgtaattttatgtgtagtccaagacaattcttcttccaatgtggtccagggaagacaaaagattggacacccctgttttagagacaaggttcttgctctgtcacccaggctggagtgcagtggtgtgatcatagctcactgtaacctccaactcctgggctcaagggattccccaacctcagctcccagagtagctaggactacaggcacatgccaccatgtccacctaattttttattttgttttgtagagacaaaatacaaaaataaaatgtttgtagggccttgctatgttgcgaaggctggtctcaaactcctgccctcaagcaatcctcccacctgggcctcacaaagcactggaattataggggtaagcgaccatgctcagccaaaaatgtaggttttagtgtctataaaatactacagattctaccactgagcaacccaaaacgttcacattatcagacccagagtgctataggataattaagataatcaacaagaaatgacaaatccctaatgcttattagaaaacagacaagaggcaatgaattcaaacagccatgtctgaccttagacagaccgaccctgaacaaaaacagccttatcatatgcatggtcttttagctaatccttacctagccctggaatctaagactgaaattccttcttacatggagaaccaggagcaagtaaatttaaaaaatggatttcataccccccaagagtaagaatcagtaagaggtggcaattatctttctctacctcataaaaaccctttatgatttttaaagatgaggaaacaggggttcgggaaaataaagtaacttgcccagtatcacaaagtcattaagtagtaggaacaggactagaatagaggtttgtctgcaccaaagccagggttctttctaccaagctatctccctcctctaaaaaatattctcttatatcaaaagctatgataagttctgtggcattctcagaccactgtggctcactacacctattaaaagtaaaaaaagaaacaagaaaggcagctgtcaagaagttgtgctacttactgcccagcactatatgcactagagcttggaaggaggcactcaaactcaattcacgtgatcctcactgtcattccaagcaatcagtcctaccccagcaaaaggcttatcactaacactctcccccagctgaggctgcaaatgacattcccaagacaacttgccagtctattacatcatgctgctgtgttggctttaaatttttaactccaaaaattaaggggaatttgtttcaacctaaaaatggcagttgcaagttaaaatggcagttgtcactacagactggtgactagagcactggctttgcagtcatccagattatgttcctaacccagttctgccacttaaataaatgtgtaaccttaggcaggtcaattcacctctataatttcatatacaaaaatggcaaggtagataacttttccataaaagatcaaatgagataatccaattcctagagtccaacacatagaaagaacgtggaaaataaatgatacatactattattaacattggtatgattctcatgccacaggaatctgggcaaatcaataatccacatggtctgaattcctgattatttgctataacaatcaactggttgaatcaggacatctgaggcaaatgaaacactgactcagttcagcttggttgagagataaccaatagaggccctggcacataccaattgctcagtaaatatttatggaattaagtttgcagaaagtccactcaggaacctcactagctgtaagattcaggagggctcattttggcaaaaagaatggcaactttttttttctacagaatttggcaggtttttcttttcttattttcaaataatattaataactaaacaaaccatataccaggtgtcaatagtgaggtttctacaaataaaaccaacatggaaaactacaaaagcagcattccagagtagaggaaagaaaaccagtttgggaatcaggcaagtgtgtgattcatatgccagtaactttacagttatgtaaacattatcttgggccaaatagtcacgtcagactcagtttccatatcagaaaattggagataagaacacctacttcacagggttgtcataaagctaatatatgtgaagcaccatgtaacagttggtaatgagtgatttttaagtctctgatacctgttttcccttctagacgatggtagaaacttccggaatgggtaaattatgcctaagggcaactactatcttccctccggctttttcgaaaggtaaactaaaattcagccatatagacaggtcaatgggctcaagttgcaattatcagtgggtccactctgacaattttaagggggactctttcatggaacttcagagaccaggaaagaaccaggctctgttctctccaggtagcctaactattccttcccttctcaggcctgctctaatatgaggttgctaaaaggtgtgcaaaggaagagtcatctttgcaataaaccaaagatgcagcatataagcaacaggccttctttgagagcccaaacccaaattaaggcacgaaattttagcactgtttggagactggaggtaaaggggagaaatgttggcattaaaataatacttaaatgagtacagaggaaggaagtcttccaggctcattaatattaatacatgtttactttccattcacatgtgggacaaaacagagtaatgatttgctaatgccaatgagctgagtacttagttcattttactatgctgcataccctcaattatatactagcaaaaattaaacctaagtaaacagaatactctacacgtctctaaagacaatattgctccactcactgaaataagacccaatcaaggcaaaaaaaaaaaaatctttttttccttcttaagtgaatttcactaagaaagatgagtcaaggaacttttaacaaatttggatttccattttcaacaaggtaggaacccgtgtacctcctcccactcaccccacctccagagaactcacaatactgttactaaaatatattgaatgatgccttccattggccaattacttttaactgaatgcaataaaaagaatccgcacttcaagacctcactaacaactacaatttttccccctcttaaatttccagttctggaaaaaactcggtcagcccactaaaaagcaactgtaacattccttttaatccagaaaaatagagacaaaaatacacctattataatacacctattatacacctattataataacgcaaatatccattatacagcatcaaggagagcacatgcaataatggctgccattccaagaacatttttgttaaaagttacatcgcatgcacagaagctgcttttccaaaagtaaacatatattcattacactgagcctcactgaagcatcctgttcttgtaaggtgagacttgtaacccacctttatatacagaatctaaagacaactgggccttatattgaactcgctctccagttaactgtgttagtgaggttccagtacagttccccaaagaaagcaatttgaatcaataaccacaccagtgctactctgaatgtttgccaataagtaaataaaatgcctgactccaatatgaagaacattttcctccttcctggctccccagctccatttaaaaattgtaaacatgaatagaaagataaacttgagaacagcaaagtcacccatgccatcaataatatccctctaactcagtgcctaattttgcagttttcctcaaacaggacagtctcaaccagatgccaggaatttaatatggcttttcaaagatatatcaaactgtctggaatatgcagtgatgaaaactgaatattgctactgaaaccatatttaattaaacacatgcttgctcagagcttcagaaataaagctacaatgttttcttccttggctctcttagaagccaccccaacaagagagggtcaccagctgcactcctgctaacagttctatcctgagcaaccctttcccatccacccccaaaaagttttacttttatctgtggaattctctgccggcctcggcctggaaaactgggtggaccctgaggacaggtgtcagatctggcctttgggaggtggcccaaactgacaaattattggcagcataaagctatgatctttataaacttcagtttgaggctttatgccagtagtgattccctccccgctccttttttgaagaggggagagaaagcaagccaaaaggatgagtttcaaaatagaaaaaaatcaccactttaattatgaaaccctcccaactcaacaaagaactgttaaaggtagccaaatggaaaatgtcaggagttttttttggcacatgcgcaactattaaacatgagaattacaacctcaaggtgaggggaaaagagtaaaaagcaggagcagaaaaggggaggacagggcccagccaaagacccgtttgctcaaaagggcccctcttggtactaactcctccatgtggggcacccaggctggaggaaagcagagggttacacagaacatttagcagacttaacattggattaaacacactactgcaagtttcaacaaatgttcatggcatacgtaaaaacacatttacaacaagaaagaagagaggcacctggagacatctgacactgggcatgctctgcaggcaactcagtgcgcacatgctctctaccaggttggcgcagcctagccacaaagaccttggcacagaacactgcaggatgacaaaaaggaaggaagagaagaagcagttagaggccgcaacaaatcactccttcacacaggcaacttgaatgttagttggggcagggggtgcacccttggcagtttggaggttagggatggtcccagacagctcactgaaaccttgggggagggcccacttgatgttctatggaaaggaggtttctgctgccaaccactaatttctcagggtacagtgaatagaatcaagagggacagagagaatgtttaaacaaaaacccaccaaagggaactgtgaaagtttgagtgcaaaacaagattagtggtgagattgtcgactacaatttcatcagtgccacagtttctcgtctatgtcacataaccataattgtcatcgttgtttaagaacctacaaaaccacaaaaagtgctatttgcccagcactttacatttgttctctaatcctcatatcattgtaaggaaaccgaggctcaaaggttaagtgattcgcgcaaggacacacaacaaaggaggggagagccagaatttcaaactttggtttgtctgctaccaaaacccacattctttccacaagactatgatgctgctattgtgaaaacttatatcaccccaacttttatcatgtgagtaaagttttgcacctccctaaggtaaaatcacaggagacctaaagaataaggcaaaaagaacaagaaagatgggtgacagactgatagataaaggcaataaaagaggtgatttaaaatgcatgattttcagtgtcatcacatctccaccttcccaaaggaaaaacattggaacgtcatgattttcattttagactttgtttacaaagtccgtctgacatgactaagaattaaaaagcttatttaatttacctcttcgatcctcttttaaaagcttgctgattttaaaggaattaagaaaaaaagtaaaatataaaatgaacatatgtactacggctactacttaataaccattagaccatactgtaaagttaataaccattagaccatactgttcaatcattcagatataaagtcaattaatttactatggcaaaatcaatactcatgtaacaaaaattaaaggtgagtgtttgggttcaaccaaaacatcccagaagtcttggacccaagctcataaacttgtttgttctagctataattagaatagccaaacaccctcatttgcctgagatagtcctggatgacacttattgtcccctcataactttcactctcaaaagtgttctggtttagtggataaattctattatcacccaactgcaatacaaacaaagatagctttgcttgaaatcagagagacctgggttcctatctagtatctgtcacttactagttacagttcacctatgatacacggaatattgagattacttagaaaaggcatttaaagaatacaaaatcagaggaaccaaatggaataaaaaaattgagcagctttctggtagcaatgaaaatgacacacttccaaggtgtgcctttattccaaagccaatacagtggcaatatatcattgaaactccaggtacacaaattttgttgcctcaacactttgcagagtaccaaccacagaaggtgctgaataaaataatgaaataaaataatgaaagtagttgccatttatcaagcttctgttatgtgctagacagctgaaatagtaaactctcacaataaccctgtaaaataggtattattccattttatgatgaggaaactgatgatcaggaaagagatatcaagcagagtcccatggaattttttttccattaagaaaaaaatttttttaattaaaacagaaaggagagcctgatttgttaaaacagcaacacagaccaggaatggtggctcacacctataatcctagcactttgggaagccaaggtggtcagatcacttgaggtcaagagttgaagacaagcctggccaacatggtgaaaccccgtctctactaaaaacacaaaaattagccaggcgtgtggtggcacacacctgtaatcccagctacttgggaggctgagacaggaaaattgcttgaacctgggagtcagaggttgcagtaagccaagaccacgccactgcactccagcccaagcgactgagcgagactgcctcaaaaaaaaaaaaaagaaaagaaaagaaaagaaaaaaaaccagcaacttgtccaaggtgcaggggaataagggctaactgatggcagaattaggactagtaaattaaacctgacaagctgattttctttccactacaacaaacactctctatccagagatattcttacacatgtttaataaaagaatacttacatcagcatacatcacaagtggatgggcaaagaagagagtttaaggactacacctagccaggtgaggtggctcacgcctatagccccagcactttgggaggccgaggtggtgggattacttaagcccaggagttcgagaccagcctgagcaacatggtgaaaccccacctttacaaataatacaaaagtagccaagcatggtggtatgcacccatagtaccagctgctcggaaggctggggtgggaggattgcttgagcttggaaggtggaggttgcagtgagccaagatcgcagcactatactccagcctgggcaacagagtgagatcctgtctcaacaacaacaacaaaaaaggattacatctggattcagcaactaatatcaaattaacaccaaagctcatacgtaaatcaatttttacttattcagtaaaaagtcaggttccctctgcaagggttaatagtatttgcctcaaagggtaaaaaccatgaaagcataaggtattgattagattctgctaataagttggaatctaaaactttttaaaaggcaatttttcacattcagtaaatcaaaaaatcacagattgtgagaacaggaaggcattttaaatactatttagtataacctcgcactgctaattttagattaagaggtgaagaaattaaatccaaattagaaaaacaatgatattatcaaggctttttaaccatttaatgatttaatcaatactcataacaatgtggaaaacaatcaacataaagaaaattttcagtgaacttgattttaaaacattagccatttattagaagactgatatttcaaagctttttgaagcttgttatttaactagtatattcagggaaagatttttaaaagaccctctgagggtcagatttccaagattttctcttcataatatctatggtagatactgtaagatataaagaatgatgccagtatttattagatgctgacatcatgctaaatactttataaaggatatctcatctcatttttacaataatcctacacaatagacattactttccccttcagaagaggaaacacaggctcagagatgaagtaatttacttatccaaaatcgcatagtgctgggttggtgctaaggtctgaggcaagagtactcttcactgagacagcttgatcctaggcagcacccaagctggtgtgtgatgcaactgccaatatctactaatcagaagtctcaactctcagatcatcccaggactgggaacttccagtttcaagacgagtgttgttttccatttggtaagaacacagacagtggttaaaaagtattacaactgcttactttcacactcaataattactttgaagctaagtgaccagccacattgctgaaaatcatctctactcaacagaaaatgctattctaggaaatacacccaccttttagtaagaaagtctgtacccgctagccaaaacaaggtaggttcctcttaggtcttagatctaatagatcaggaggacattgatccaatttgaaaataatggataaaaataaaagttccacattcatcaacctaagagcattaaattacagctaggaccacaacagtaattgattttttttttcttttgagatggagcctcgctctgtcacccaggctggagtgcggtggcatgatcttggctcactgaaacctccatctctcaggttcaagcaattctcctgcctcagcctcccgagtaactgggattacaggcacctgccaccatgcccggcttatttttgtatttttagtagagacggggtttcaccatgttggccaggctggtcttgaactcctgacctcaggtgatctgcctgccttggcctcccaaagtgctggcattaaaggcatgagccatggctcctggccgtaagtgattcttgaagcttcaaatttttaatttagggacatggctggaaacccatgttgatcattcgagaataactattatccatgattgcttaactattcagttagaataatgaaaagatttcttcatattagctaaattcacagtacagacgattgtcctttttttttaagtgagcagtgttctttcatattgctaaaatatgtctgaagaatacccctgataccatgggtatttaccaattttaacaaatacttattgacctgcttattaagccaacaatacacactaagcctctttccccttaagactttagccttgagctcaagagaaacaacccaggaggatcatagtggggatacttaacagaagactttggagggtcaaaaattgccaagatacatttgttataatttcgtatttagctacttgtaatgattaatattctaatttagggttgttcacagagaacaggaaatgattcataatgggttgtgatattaacagctaatacctaattagattgtatatttgtaggttctatagctgaagaaaataatattagccagggaagctgacagtgtttattacttttgccatatccaccgtataatcaaaaaaacctaaatcgaaaccattatgctgagaaacaccataagtcagtaaagacaaaaagaataatctcttttggcatttttcaaaagcaaaaagtttattaaaagaggtaggagaaaaatgtcctaggctctcttcctattaccataggaaccacaaatcaaaaggaaaaagtggttgcaggcaccttgtattctgattggctcacttgaagaactcacaaaagctaacttcggtctgtttttagatgggattgttttgaatctcctgccctgattccttctcaaagaagcagttcttttaaaatttccccaaagaggtattttatgttaatcatctctctaatgttataacctctgatttagaaatctgccttattataggttttctataactccccccaccaccaatctttttatttaatccacttcccacagaatcattaccagcttcttctcactcctgtcatcatgattgaagtaatcaagttgagtggctgttccattaaccaaaaaacttatctgaacttatatctatctgcacatagtaaagcaattaagacattctctttattctccaggagctcacagaaggcaatcttaaacttataatgtaaatacacatacacacacacacacacacacatatatatatacatacacacacaaatatgaacttaacccacccaaaggaagaggatgcctgaactaattcataaagggtaagtaggaggcagccaggggaaaaagagaaagacattccaagaagaatacatagcataagcaaagccaaagaggtaaaaaatgaaacatcctatgcaagtatctgcaattaatttagcattaaaatacttaagtgtgagatgagaaaggcttaattagagagacagggagggaccagaggtctctctatcaaacttgtgacttaatcccgtagaacaacaggtcttaaactctgtgctacagcccatcagtagttggcccaatgcttctcagctgtgtcatccaattttacatcaatgtgaatgacttttttttctgcaactcagcagatacacagtttgtacaatatctgtcagagaggaatagaaacagatcatgcaacacagagatggaggtggaggtggacaggggatggaggtttttagattaagaggtaaggggtgaagcataacatcaagccaaagccaagccaaatcaagccagcaacaaagaaatatcccatgttttctagaactcgtggagaatatttgccgcaaacgataaaagaagtctgctcaacagtaacccaatgacaaagagtgtaagcagatagtacaaaaaccaaggatgtttttatagatattatattacggattttgttaaagaccagagtgttctgaatgtgttaaattcctttaagtgagacatccaaaattttaatattcaaatcactgctacagacaatgatgagacagctattaaactgttttaagcaaaggaatgacccttggcagctgcagccaagcatgatttgcagagaaataaggataagtctcttcgagaatctataagatagcagctcatttttgttttacaaacaatgcaatttctttcagatgggctacaaagagtagacacaagaaccagcacttaccaactttcatactcagtctaggtccttttttctccccccacaaaacttccaccaggccctactgatagaatatcaaacaaagagtgccatgataatgatgaagaagagaaataaaagatcaatttcatggggtaaccatttggcagtaatgccctttccactgggaatctctagccatgagtgaggactgggtcttgatgaatcagacaataggtgggctcaaggggagtacataactccagctctctaaacctagacttgacagctagagtccccattcagtttctgctgaagactgccaaataaactaagcattaaagttaacccaacttaggaattatcctattgtgtctcatctctcagcctgttgcttttcaagaagcagcagtgtttgtaattaaagtaaggacaaagcattcagaagagtcttctaaaattcagaacctaggcttccactattaatgtctgatggcaacctataagaaagagcactctcaccaccataaatgcattgtttttaaaaccaagaatcacaatgtagcaatcaggttgttaaataaaagttaattcacggtttaaggcattttctataaccttttatagaactgaatattggcccattaccctaatgtgcaaaatactttcttttccttataatggcattttattataacagaatttgatagtaaacatgtgacatgtaaccaaaaagtttacattttaattcttagcaactgtattctagaattatgttcttgtcataatattatatcacagggtatattcaggctgggatatatgttaagggaagaaaaggggatgcagagaagtaggcaggaaggggagaaaaaaaataaggatgagaagaatgaggaaaaccaaaatttactatctgccaagtttttagattcaagaacagcccaaaagtagtggaatcaggactcaaagtcagaggccaaactttgcttaaacaccactataatttttttaattaatgtccaaacaattttcatcttgaattattctaaggtaagatattagaacccatccaggcaagatggctcatgcctataatcccagcactgtgggaggccaaggcaggagattacttgatgtcaggagtttgagaccagcctggccaacatagtgaaagcctgtctctactaaaaattacaaaaaattagccaggcaggtggcacgcacctatgatcccagctactcaggaggctgaggcacgagaattgcttgaacccaggaggcagaggttacagggagctgagatcatgccattgtactccagcctgggcaacagagtgagactcttgtctttaaaaataaaaaaaaaaaaaaaaagatatcagtacccaaaagcattaaaactaaaatggatcttcactgtaatctctctggtagagagatgaagggtaatgttcttttcaaatttttattcatccatattttccgatttttctccaatgaccacctagtactcatattaataccttaataataccaagtataattttaagtgatgacttattttgtttaattataaagagtaacttgacaatttttttttaatggggcagttcacaacatattcatgtagtttggctctgtgtccccacccaaatcatatctcgaattgtaatccccacgtgtcaggggaggggcctggtaggaggtggttgactcatgggggtagacgtcccccttgctgttctcgcgatagtgagttctcacagaatctcattgtttgaacatgtgtggaacttcccccttctcaccctctctcctgcatcagcgtggtaagacatgcttgtttcccctttgccttcagccatgattgtaagtttcctaaggcctcccaatcatgcttcctgttaagcctgcagaactgtgagtcaattaaacctcttctttatgaattacccagtctcagatagttctttacagcagtatgagaacggactaatacacaatttaaataaaaacatattcttttaccaggaattaattttgagtccatcttaaacatccacagtttaaaatgtgtttaaatgctcagtgctagaaaaatatttcacctagtggcccttggaaacatcaaaatcataatggtttattcctgaggaaatccaaaggaaaaaaaaaatcatccttgtccactttacaactaccacccatgattcaaaaatgtcaccaagtttttcagagctcttacagaagctggaggaggaaagaattagatgtttgaggtgggaagtggaatctctattctaagcagcatgacagagaacaggatgtaacaaaataatctatttccggcatagccacatggatcctcagttgtactaggaccagcgtgaggttcagctgccaagggggaacagaatcccccagcaagctcaaggttaaatcagtctgaacccaatcccaatgaggtttttccaagatccataaatcctgagcctggagataatttaacacctaagtacatctgggcctttgttggttagcagctgtggtccaactaggaaagttgttcaggactagggcgagacctctcaaccctaagtttaatctttttcaataaaaatgttaaatgacatgaaaattaacaaagaaggataaattgggagggggtacaaagtgagtaccctatggctataccgtactcattaactctcataccacctctggccaaacaagcagctgagttttacagacaagaaaaactaaggaccacagacatcaaatcacttgccagaggtcaagaatggcaaaactgcattctatctgactctaaaatccctgctttcttcccttatctataattgcccgtcacttcctttacctgacattaaactccgtagagcagcaagtttccctgatttattttcaaattttatctacctgtcactcatctatattgctgattgatacaatctctggtatgcaactctgcaatacatagtcaagacttgaaactcatgcacatcatttgactcagcaatttcacatgtaagaaattttatcaaggagacaaaataaagaaatgtccaaaaatatagccaagaagatgtcattcacatcactgttcataatagcaaagggaaaatgctaaccaaagggacaggttccacagattagggattacccataagacaaactattgtgtttctgctaaatagaaatcatgctatacgaatatatttacagacactaaaggaagtttaatgcatagaaagaaagttacaatacacggaaagaattcaagaaacactaagtgaataaaggcaacaaaccaggacttacattatgatcccatgttcatttaataaatataatatatacataggccgggcatggtggctcatgcctgtaatcccagcactttgggaggccgaggcaggcggatcacctgaggttgggagttccagactagcctgaccaacatggaaaaaccccgtctctactaaaaatacaaaattagctgggtgtagtggggtacgcctgaagtcccagctactcaggaggttgaggcaggagaatcgcttgaacccgggaggcggaggttgctgtgagccaagatcacgccactgcactctagcctgggcaacaagagcgagactctgtctcaaaaaaaaaaaaatgcatatatatatatatatatatatatatatacacacacacacacacacacacacacacacacacacatataaatctggaattaaacacaggtgatttttattttattcttttgggctgccatattttttcagatgaggccatacaattgacagctcaaacttctccattccctctcctctgagccacctctaaacagaatattggcatttccacagttacttagggatcttatcatagcaacttgccccctgactgtagtagaccattctcctaatgaaggtggagagcaggtagggttaggacagctataagaatttggttgccgggcgcagtggctcacgcctgtaatcccagcactttgggaggccgaggtgggcggatcacgaggtcaggagatcgagaccatcccggctaacacggtgaaacccctcgtctctactaaaaatacaaaaaattagccgggcacagtggcaggcacctgcagtcccagctacacgggaggctgaggcaggagaatggtgcgaacccgggaggcggagcttgcagtgagcggagatcagccattgcactccagcctgggcgaaagagccagactctgtctcaaaaaaaaaaaaaaagaatttggttgcactttgaggtaacaaagacactctcctccattcatttcaatgcttctggcttctagatagctaacagatgatctccagtcagaaaactcctaagtatcttctaagttactacttctaaatatgtgacagtatatagtccataccgcatgacatctgagaggtcttccaggtgacaaaactaaaaccccaatttgttttttagacattttctaggaactgagagacatctgctctcatttatactagtgcccctgtccccaccctcagttaatccaacttccccttccctaacatctaagacactagtgctggctgcatcgcttcctgctccttctacccaccatcatgagtcaaaagactttaatcagagaatttctggaaatatgtgcacaacgagatcctgattgtcctctaatataccaagccaaaatccttaccctactttcatttaacagagggcaaagttgactacgtttttaaaagaacattagaacacacggaaggggccgggcgtggtggctcatgcctgtaatcctagcactctgggaggccgaggcagatggatcacgaggtcaggagtttgagaccagcctggccaacatggtgaaaccctgtctctactaaaaaaacaaaaattagccaggcgtggtggcacatgcctgtaaccccaggtgctcaggagtctgagccagaagaatcatgtgaacccaggaggcagaggttgcagtaagctgagatcacgccaccgcgctctagcctgggcaacatagcgagactctgtcccccatcaccccccaaaaaaaagaatgtatggaagggaaaactttttctcctgatgtaatgaacattctcatttttttctaagaagagataccactttctggaagatgacctgagaaatgtatcttctctcaataaaggtttgacccaattatagtcagactacatcatatttctattttatctttttcattttaaactgcttagtcatttaaaaaagtttactaaacatcaagtatactaaatgctttgatagacaaaaattctcaaaactatatattctggtattaaaaattatttctgcaaataaagccatattgcttaaattatttcctggtttgctaaacggaaaaagatggctaaattcctaaagtatgaaacattttaaataaatgcagttccactgccttcaagagtattaaaacttaactagcagctttttttgtttttgtttttcagacaaaattgcgctctgtcacccaggctggagtacactggcatgatttcggctcactgcaacctctgcctcccaggttcaagtgattctcatgcctcagcctcccgagtagagctgggattacaggtgtgcaccaccacacccagctaattttttctattttcagtagagacggggtttcactgtgttggccaggctggtctcaaactcctggcctccagtgatctgcccacctcagcctcccaaagtgctggtattacaggaatgagcaaccacgcctggcttaattagtggtatttttaacatcttttgtagacttaacacttccaaagactttgaaagtccatctaacatgctacttgtctcattgagagctctgaaaaagtacctgcagaataaaagttggccctgttaaaaaatcttttgaattctgctatgttttggcttcatgtccccacccaaatctcatctcccattgtaatccctcgaaggagggacttggtgggaggtgactggatcatggaggcagtctcccccattctgttcttggtatagtgagtgagttctcaggagatctgatggttttatgagtgtttgacagttcctcctctctcacctgccaccatgtaagacatgcctgcttccccttccaccatgcttctaagtttcctgaggcctcccagccatgcagaactgtgagccaattaaacctcttttcttaatatttataaaccacccagtctcgggtagctctttatgcagtatgagaacaaactaatacaaattcaaaccttacatcatttaaacaagccctctactattttataaacactactcatttcttgaatacatacaacatttattttcaaagacttaacaggcccctacaccaaataaatacatgttccaagttagtagtgttttaattttatatacatacgcccacacagagatttggaaaacaatggtaataaaaattttgcttctttagctaagaacagcatgaaaagcgagttgtcaaagataataaagtggcacattttatcatcccttaattttacagtaaagtttacacttgctcttcttcatatagttcattgttcttatatcctaagctgaccttggtttcaaataaaaataaaatgtgtgccttacagtccactgggctctaagaaattaatttgtctttcaggcaggggctaggacagccttagagtaagggactcctgctgcttgctgcacagcaaggatgtctttgattcccttcacattgtttgaatcctgcaggcaactggaaaaggggagttctcacgacttgaagcaaggaatttcgctaaatgctggagctgaaagggaccttacagactttatagaccattttgtccatgttcttaaaatatttttctagtctagttcctctaaatctctcacactgtgctgtcagtacacaccacttgaaagcacccagtcttaacagcagatagttatggcttaacacctgcaacaataaagtcaatctataggtttacagatgctttttgcatgtgtacacatgaatatggacagaaaacaacactctggaacttctcacaaaggaatatatttatcatctaaggttacaaaagtcttataaactactgcagaaacagagtactactattacaagcagagtctcatctgtgcccctcctttaagaccctttttccatgcgttgtatgtaactttacccctgacttcatctttttgtcctatttttcctttcatcttcattttcccacttattttgtttttaatcttcctacactgtatatgtcactgtaatcactcaaatcctttttctgaaataaactaaggtttctgtatatgttaccagcagcaaaagtcattacgtttttgcaggcagtgaggaggaaaaaaaaaaatttattacatttttgaactgagaaaaagggaaaagttgaaaattaacaactatagggaggctgggcatggtggctcacacctgtaatcccaacactttggcaggccaaggagggtggactgcttgagcacaggagttcaacaccagcttgggcaacacagtgaaaccttatctctacaaaagatacaaaaaattagctgggcctggtggtgtacaactgtagcaccagctactcagaaggctgaggtgggaaaatcacctgagcctgggaagtcgaggctgcagtgagccgagattgtgttattgcattccagcctggacagctcacacctgtaatcccagaattttgggaggctgacacaggagaattgcttgagcccaggagtttgagaccagcctgggcaacacggtgaaaccctgtctctacaaaagatacaaaaatttagctgggcgtggtggtgtacacctgtagcacagctactctgaaggctgaggtgggaaaatcacatgagcctgggaagtcgaggctgcagttagccgaaactgttactgcattccagtctggacagctcacacctgtaatcccagaatttggggaggctgaggcaggagaattgcttgagcccaggagtttgagaccagcctggtcaacacaatgagacctcgtctctacaaaaataaataaataaataaataaataaataaataaataagccgggtgtggtggcgcacacctctggtcccagctactagggaagctgaagtaggaggatcgcttgagccccggaggtcaaggctacagtgagccaagatcatgccactgcactccaccctgggcaacagagtgagactctgtctcataaaaaaaaaaaaaaaaaaaaaaaaaagttaaaactataggactaaaacttttttttttttgagacagagcctcactctgtcacccaggctggagtgcaatgacgcgatcttggctcactgcaacctccgcttcctggcttcaagtgattctcctgcctcagcctcccaagtagctgggattacaggcgcccaccaccacacctagctaatttttgtatttttagtagagatggggtttccccatgttggccaggctggtcttgaactcctgacctcaggtgatccacccacctcggcctcccaaagtgctgggattacaggcgtgagccaccgtgcctggccaggactaaaactttaataccagttgttagtgccatgaaatgtgtcatcattgactttggcaaactaacaaccacctgtggacattccagcagccaggttattgcttcaccatctatcataaataaactgtgtaggctttaactcagaagaacgcatatgcacagaagtactgtgctttcaaggaccacttacttggaaagaatacagaatatcacaaaagagagagtactgtggcacagtggaaagatcacaggtttgttttgggttttatttcattctgttttttaattgaggcaaaaacacactgaacttgaatctaaccagcctctgatctagctaaaatttataagaaatacaaagaggaacaaaatatgtagaccaaatgagaacataatctgcaacacccagaaagtgggaagttatacagaacaaataagcaacctagcttcttcaataaataaatggcaaggaaaaaaagatgggagaggcgatttttatagattcaaagagatataagaaactattcactataagcaatctgtgacctaagtctggatcctgaattcaaaagacaagctaatgcaataatttgaggaaagctaaagacaaattccaatagagggcatcctacaatgtacctgagtggtactcctcaaaacagtcaaggtcataaaaaaagaggacagtctgagaaaccataacagccaagagcagcttaaggacacacaacagcaaagtgtaaggatggtatcctggatgagatcatagaccagaaaaaggacattaagtaaaaactaaggaaatctgaataaatcttggactttagttaataataatgcatcaatactggttcattgattgtaacaatgtatcacactaacataaatgctaatcataatgaaaactggggagtgttggggaggtaagggggattgagaattctgtacaacctactcaatttttctgtaagtttctgtaaatctaaaactgttctaaaaatagactattaatttaaaatatatttatgaaacaggcaaatatgaacattatttgatatttaaaaattattagttttttagatgcaaataatggaatgatatatatgtgtgtgtatgtttttaagtcttcgtttttgagtacttatcttttacagaaattcatggatagatggatggatcaagttaagaggggagattagagcaatgtttcccaaagtttggtactcaagatgatttttggtggtacatgaagattcttttaatgtttcatagctacatgtttaatttaaatatatattgtaaaaacataggtcaggcacagtgtctcacgtctgtaatcccagcactttgggagaccgagggtggcgaatcacctgaggtcaggagtttgagaccagcctgaccaacatggagaaaccccatctctactaaaaacacaaaattagccgggcgtggtggcacatgcctgtaatcccagttccttgggaggctgaggcaggagaatcactggaacccaggaggcggaggttatggtgagccgagatcacaccatcgcactccaccctggatgacaggagcgaaactccgtctcaaaaaaaagaaaaaaaaaaaaatacacacacacacacatatatacaggtagcacatcaaacacatgattttataggttttaattgcttataagtttcccttatacataaatttcttgaagctaaaaaaaaaacaggaagaagccgagcataacctatgcctacagtttcagctactcaggaggctgaggcaagaggatcacttgaggccaggagttagaggctgcagtgtgctacgactgcacctataaatattcactgcacttcagcctgggcaacataacaagacctcatctcttaaaaacacagagagagatatcattgtcaaaaaaacatgcaaaggttggttaagatcccaagtctaacactatgtgacctcttttgagaatttcgatcttgttgcccaggctggagtgcaacggcactttctcggctcactgcaacctcaacctcccaggttcaagtgattctcctgcctcaaccttccaagtggctaggactacaggcacgcgccaccacgcccggttaattttgtatttttagtagagacagggtttcactgtgttggtcaggctagtctcgaactcctgacctcaagtgacccacccgcctcggcctcccaaagtgctgggattacaggcgtgagccaccacgcctggcaatactatgtgacctcaagcaagttatataacctaagagtcagctgtttaaatggctggagaggtacaagacctgctatattaaaagagacatccaataaacaatagctgtgaaattactaaataaaaatcaacctaaaactccaacaaagaagccatatgccactagaaaagaatggagctgggagaacaaggaagggaaggaacatgagagtttacagaggcagtttaggcagaggcagtcaaggcttcccccttttcttctcaatctacccaaatgcagagaatctgctgctggccagccacagcctggagatcctgctgctcctgagcctcaggctctctcgagtgctgctggctaagatgtggttattacagaggtggggcctctagaacaatcagaagagtttttcttaccccatgctggtgtgagaaagagcacaggcattacagtaaaaatgaataagtaaaatgtaagtaaataaaatctatcactttgctatctacgtgaccttgggcaaaaattaatcacctccagttcctacttcttcccatgctaaaatgtggaaaacaagtctacctttcaaggttacagtaaaggttaaaagaaacagggggtgtaaatctggcaaacagtaggtatttaacaaatactagttctctcctccctccttattttggcaggatgacaagagaaactcttggtgaataaaagggattagggcgaacaaaaatcataaagaatagcatttccaaaagtgtgtctcttggatcacacagatttcgaaccaaatatatggggggaggaattctgggatcagaaagtttgggaaatgttgggaaacacattattaaaatgatgattatcaggtgagtttccaaaaggagactatatacagcatttactaacaactcacaggaataatcaacctattaatcactaaaacacatgaggatggaaggatggagagagggaggggaggaagggaggaagaaggaggggaaggcagcagttaaggccatgacaactccttcaaaatgatagttgaagtaacagtgagataaaactatctggacgacttacaagtcaacgacagttttaaaatctggtttagaaccagagaggggagaggggatgctttttcaacttctgaaagaagtttctgatgccaattatttaattttcaggatcaagtcaattacgagatggtactgaaacagaaaacaccaagagtttaagtagcaaatatactcactttggaagtagaaatagccttttgatataagatagtaattctcatttgctcttccaaatttattccctcattcgactgggcaactgcttggcaagcactgtgatagatgctgttatggattgcatatgtcctccaaaaagcatgtgttggaaacttaatcccaaatctaacagtgctgggaggtggggcttaatggtaagtgtttaggtcatgagggctccactctcatgaatggattaatgccaattataaaagggtttcaggctgcaagttcaatctcttgctctatcaagcaaagctctctcacgcccttccatcttctgctgggataatgcagcaagaaggcccttttgagattcaggtcccttaaccttggacttcccagcctccaggtgagctctaagacataaatctctgggccgggtgtggtcgttcacgcctgtaaccccagcaatttgggagcccaaggcaggtggatcacctgaggtcaggaatttgagactagcctgaccaacacagtgaaatcccatctctactaaaaacacaaaattagccaggtgtggtggtgcatgtctgtaatcccagctacctgggaggctaaggcaggagagtcgcttgaacctaggaggcagaggttgaagagagccaaaatggtgcagcctgggcaacaagagtaaaactccaactcaaaaaaaaaaaaagaaatctctggccaggcagggtggctcacgcctgtaatcccagcaatttaggaggatgagacaggaagatcacttgagcccaggagtttaagaccagcctgggcaacatagggagaccccaccttcacagaaaatttaaaaattagtcgggtatggtggcacgtgtggatcgcttgaaccctgcctagaaaggtgaggctgtagtgagccatgactgcaccactgcactccagcctgggcaacagagcaagaccatgtctcaaaaaaaaaaaaaaaagaaagaaagaaaagaaaaaagaaagaggaagagaaagaaatctctgttctttataaattacccagtctcaggtattttgttatagcagcacaaaacaaactaagacagatgctgggaatgaatatgccatgaactgaagatgacaaaacagatatgatcctcgcccccatggagattactttctaataagagctgattgtctagcaggggattacgcaatacatttgtgtatcagtccgtttcatgctgccaataaagacatacctgagactgggcaagttacaaaagaaagaagtttaactggacttacagttccacatggatggggaggcctcataatcatggcagaaagcaaggaggagcaggtcacatcttaagtagaatggcagcaagcaaagagagagaagcttgtgcagggaaactcccctttttaagaaagatcagatctcgtgagacttattcactatcacgagaacagcatgggaaagacctgctcccatgattcaatcacctcccacggggtccctcccacaacacatgggaattcaagatgaaatatgggtagggatacagccaaaccatatcaatttgtaaactacagttacattaacagctgtaaaaataaaaaaagaactgactgctgctagagcatgacaagggaacttaatctataagggtacctaggggacccaggcatggctcctaaggagttgacacttcagctcaactctaaaggacaagcagaggttaactagacaaggaagaaagggtgacccctccctaataatgagaacaaattataatgcttgttgtaaccctcaagcaggttcagaggaacagagaaaaagaaaaaaaaatcactgtgactcaagtgcagaaagcgagggtgaaaaagagcaaaaatagacaagactcaggaggaaaacagaggtgtcaaagttggggttactgactgatgcaaccaaaatcatcaaaggaatatcaaagtaaaagacaaactacattggcacttgaaacctgtccagtggtgccctccacatatataagttttttcaaggtatttctataaacataatacaggaaaaaactggacgagaaatagggttcagtgcatattaagaaataaaagcccacctgagaaggggaaggaattcccaacagaaccccacctcaaagcagcaaaggctagtagtaggagtgagagtccttgaagctgtcagtgaagccaacagcaactgatcctaaagtgtctcacagagagcatccagagccagagtctacgcagagaagggacccaatttccatttgccatggacagtatgcagagtgaggcaaacacttccacagctggcttttaacaaaaatggccatttcaatcacaaaagggcagcagcagtgccccagtcacgacaaaatcagaagttcctcaccctagtgatttccttccgctacactcccccatgcacctagaagcagcagagcagaactacagctaattttaacacttctctttcttcacaaaagaaatacgaatagccacaaacattagaaaaatacatccaatgtcactagtaacttaaatctttaaatctttaattaaactgagattttttgatttattaaaaccctaaaatggcataaacatgaagaaagcatgtttcatgcagagaatatagtctgtcatgtcacatcatgttcataaaggttaagaacagtgggtaaaacctttggctatatgaaatactcatgctcttaaaaaaagttagagaccatcctgtgcaacatagggagaccccattttgtctctacaaaaaccctatattttgtctctacaaaacttcaaaaattagccagtcatggtgttgcatgcctgtagtcccagctactcagtcaactgaggtggatcacttgagcctgggaggtcaaggtatgagccacaatcatgctactgcattccagcctgggaaacaaagaccctctctcaaaaaataaatatatacatacataatacatacatacatacatacatatgtacatgtatatgtatagatgaaggaagggaagaatacataccatatattaatagtagttataatggaaactttgttctttttccatcttactttacgtttttcattacatttttccatcttattttacattatatttattttcattttttctataataaatgtgaattgcttctgtaaaaaaaggtaagttcctattcaataattttgcaattattttttaatatatgtgtaaataatggtggtggactaactggttaacaacatgggggaaaaacgaactttgatccctaccgcaaccataaaaaacaattattttgagatagtaaaaccctaagacttgtttgaaagccttgttccctggtgccgtaaagaaatggcacttgaacataaatttaattttctcagcaaggccatttttctattttctgcagaaagggtacactcgccagcagcttagccacgagagtacactgaacaaacgagacagggtcatttataacctgacatgtccaccctactgccgtgtccagtttcaattggctggaacaggacctcacattttgtatttgtcccgattggctagcaacttagaactttttaaaagaggcaaaggcagaggagaacaaaggaagaaggaagtaacttgtggaatgctgagaaaggtaaaaacaccttcaaataaggaagaggaacaggctatgacctaatgcttgcttggaccagtataagcatgccagggcaaatacttaagctaaattgtgggagctaagaacataaagtatattgatttctttattacagctagcagatatttaagaatgatggtacaggtctttgaataaattttgcttttaagagaagttactatttattcctaactagatggggaggaaagtctttgaagacaaacctctactttactttttacagacttctagaaataaataaaattaccttgaagaccttaaaatttatcaaacaggacatgaaatacagtaaccatgaaataaaaaattggacttcattagtattaagacctgctatccatcaaaaaacatgattaagacagtggaaaggcaagccacaaaacaggagatgtctgcaatatacgcatctgacaaaggactaatttccagactataaaaagactcataaattagtaagaagaaaactcaattttttttataaagtcaaaaaaggcgtatctctaaaaaggatattcaagtgggcaataggcacatagaaatgtaaattaaaaccacaatgaaataccatttcacacctatgagaatggctaaaattaaaaagactgacaatgccaattgctgactaggatgtagagcaactaaactcatattgccagaggaagtataagaatgtacaaccactttgggaaaagatctggcagtttcttgaaacacaaaatatacatcttgtgacataagaaacatatatttgatctttgctgccctgatgacccccattactggcacaaaagcgaaaattcttggaattgcctgagtgatagtattgagaggagcatcttttgttattcaaaataagccactttcaaccatactagagtttatgctaataaggtgactcttggaagatgggggctggctgctagaggaaccatgatccaaattttcactgcccccaccaccatctccgggaaaaggaaagggactggagacgggagaggagctaggaattgagttaatcaccaatgcccaatgattaatcattaattaatcattaatcattcctaggtaatgtgacctccattaaaaaaaaaaatcttaaagggcagggttcagagaacttctgggatggcaaacatatgcctctaccaggaggatggtataccccaacttcacagagacagaagctcctgcacccaggacccttctagaccttgccctacatacctcttagtctgactattcagttgtatcccttataatgttctttttaaaaaccaataaatgtaagtaaagtatttccctgagttctgtgagcctttacagcaaattactgaacatgagcaggtgatcatgagacccctcaagttataaccaaaagtaccctggcaacttaggacttgtgactggcaccttaagtgggggcagtcttttggttaatttaagggatctcactagctccaggtaaatacagtcagaattgaattgaactacaggacacccagttggtgtctgcaaataactgaagaattgctttggtgtggaaacaaaaaacatttggagtcaggaatgatgttagcgtatagaaaaatagtttgttcctttacatttactctatctcagcaatccactactaagtatacccaagagaaaaaagatgtcctcacaaagatctgaatacaaatgctcacccaagttttattcataatagccaaacgcaggaaacagcctaaacatccatcagtagaattggtaaacagttatatactcatataatgcaatgctactaagcaataaaaaggaatgaactgatacaacaagaatgaatctaagataagtcaaacataatagagtgcatacagtatgtgcatcttgtatgattccatcttatatgaaattccagaacatatttaactaatctatagttatagaaggcaggttatttagggctggggcagagaaatgactgaaaaggggaacagggaagttttttggggtgacggaaatgttccatatcttgatagcagtagtggttatgtgagtatatatatttctcaaaactcaaacagtacacttaaaatgagtggattttattgaatgtaaaccataataaagctgattaaataaaaaacagaaaccacaatacagatactaccacgcacccattagaagggttaaattttattttatttatttttatttttatttatttatttatttttttgagacagagttttgctcttgttgcccaggctagcatgcaatggcataatctcagctcactgcaacctccgcctcctggcttcaagcaattctcctgcctcactcagccttccaccaagtagctgggattacaggaatgcaccaccacccagctaattttgtatttttagtagatacggggttacatcttgttggtcaggctggtctcaaactcctgacctcaggcaatccactcctaaagtgctgggattacaggtgtgagccaccacgcccagccagaagggctaaattttaaaggactaaaaataccaagtgatggctagaatgctctacattagagatggaaccaactggagtacagacatttagaagacagtttagcagtgtggtgttatgacacatacatactggttttcatccaatgcagcaaaactcccacagcccttgttacagtgttttgttataatgttaggtaagttaggcctcaggaaacggaatctcggtgaccttctccagccctcctttgacctgacccgaggcacgactctaatctttaagatcctctgcagagagggtcctgccttataccccaggggaaggcatgccgatgtcatgaagcttccataaaaacctaagatgtgagcagtggctcattcctgtaatcccaccactttgggaggccaaggcaggtggatcagttgagcccaggagtttgagaccagcctgggaaacatggaacacctggtctatacaaaaaaatgaaaaattaaccgagtgcacacctgtgatccaagctactcaggagactgaggcaggattgcttaagcccgaaaggtcaaggctgtggtgagctgtttgtgccgctacactccagcctaggcaacagagcaagaccgtctcaaaaacaaaacaaaacaaaaaaaccaagaggacagggttctagacagatgaacaggtggaggttcctggagggtggcacactcacagagggcatggaagctctgccccatacctcaccctacacatctcttcatctatatcctttgtaataatatcctttatgataaactggtaaatgttacctgtttccctgaattctgtgagcctttccagcaaattaattgaacccacagtatgggtagcgggaaccccaacttgaagcaagttggtcagaaggacaaaagcccaggcttgccactggtatgtggggtaggggggcaatctcggggaccaagccctcaatctgtgggatcggacactatctctaggtagattgtgtcggaattgaattggggaacacacagctggtgcccgctgcagaactgattgctcactagtggtggagagaaacccactcccacacatttggtcacagaagccttcttctgtgttcatgactgctgttgtactggtttgagagcagaggaaaaacatggtttgagagtttttcccaaaacaagcagtatctattaaagctaaatatatgcctacccccattacccagtaattctgttgggttctcatacccaagagaaacaagtgctcatgtctaccttagaattgctgtccacagtagcagacaaaaattagaagcaactcacgtattcatcaataacagccaagtactcagcaacccaagcatttcatcaaccaagtaaaacaaacaaactgaatatttacaatggaataatgcatagaaaaaaaaaaactacagccacacataataaaacggatgaattttacagacataataataatgagtgggggaacaaaaccacaagagtatatactctataatcctatttacataaatttcaaaaacagacataactagcctacagtgaaagaggtcagaaaaggcctttaagaagagagttcattgactggatgagctacaggcaagaggaagccttgaaatgctctggaaaaggtctataatttgatctaggtagtggttacacgatgtgctgtgcacacatgtaaaaattcattgagctgtacacttaaaacatgtattctttaatgtaagttatacacaataaaacatacctatacaaatgctcttttaaccaatctctgtttatcctccaaagccggaagcttattacacagtagccaggcatggcttgtcagtcaatctcacttctagtctacccatttacatgtacttcatgtctatctccctcagcatgtgtgggctggaggtaatactaaatatccagaataatggcaccggtaatggaactagataaagtcatgctccaatcagggagaatttctgacaaaatagttataaacagtctagatgatcataatatggtataattttaagtgtgggggaaaggaccttatgaattcactatccttttaacttctagtagcgattgtaggaaaattaaatacatgcagcaagctccttaaaaataagtatatagctttccaatcttgtttaaaaatttagctccataattataaggaaaattatagaaaaaaagaatcgcactataaatatttactttatgcacaattttcaaaaataaaggcaggtcgaagttacattttttgcagaagcatgttatttgcatattataaaactaagctttacggtgacgacatgcctaaaactattactactgccttccaaaattaaccaacaggttataaaaacaagcagttaactttcagacactgatttatgaaggcaaagcttttcagaaacaggactctcttaatagtctgatttacattcatatcaatacaaacacacatatacgcacagctatcaacacagtcatccactctacatctaaaatgtctcatttcctcctcttcataccatctgttactatctcatctttccttccctgggacattccaacagtaaatgaatcagtccccctgctccaatttgccctgctctaaagcatcctctaatctgacaactggagtgatctttgtaaaccacagatcttgctctaatgttcacagtcacctcccttctcaaccacatccaccaccctcatacctcctccaatctaggcagggatcacacgctcaaaaacttacatgtggctcacacctgtaaccccaacagctcaggaggcctgggcaggaagattgcttgaggccaggagtttgagaccagcctgggcaacagtgagacccagtatctaaaaaaaattataaaaatagaccagatgcagtggctcacacctataatcctaacacttcaggaggttgagagataaggatcatttgaagccagttcaagaccagcctgtgcaacacagcaagacttcgtctctacaaaaaaaaaattaaaaaattaaaaaattagctgggcatggtggcatgctgctgtagtcccagctacttggaggctgaggtgggaggatggcttgagcccaggaattagaggctgcagtaagctatgactgcacctctgcaccacttcagtctggggaacagagcaagaagaccctgtaccgaaaaataaaatatgattttaaaacttagccagacatggtggcatgcaccagcagtcccaactacttgggaggctaaggcaggaaaatagcttacgtccaggaggtcaaggctgcaatgagccatgatcacaccactgtactccagcctgggtggcagaacaagattctgacccaaaaaaataaaaattaaaaatgtatatgaccaattagataaagtgaaattggtctcataggagttacgtacaggaaagtacaagctctgactcaaaaggacagctactactgagctccaattttcaaacaaaaccacaaattagtgttttcatatgaaatgtcccaatttttaaaatctggccaggagcggtggctcacatctataataccagcactttgggaggccaaggcaggtggatcacttgaggccaggagtttgagaccagcctggccaacatggtgaaaccccatctctactaaaaatacaaaaattagccgggcatggtggtatgcacctgtagttgcagctactcagaaggctgaggcctaagaatcacttgaacctgggaggtggaggttgcagtgagatcacaccattgtactccagcctgggtgacagagtgagactctgtctcaaaaacaaataataaataaataaataaaatccgtgtggaccaggccaggtgtggtggctcacccctgtaatcccaacactttgggaggccaaggaggatggatcatctgaggtcaggagttcaagaccagcctggccaacatggcaaagccccatctctgctaaaaatacaaaaattagccaggcatggtggtgtgcgcctgtagtcccagctacttaggaggctgagataggagaatcgcttgaacctaggaagtaagggttgcagtgagccgagatggcgccaccgcactccagcctgggcaacagagtgagactccgtctcaaaaaaaaaagaaaaaaaaaatccgtgtggaccacataaaatatgtttgtgaagctctacctatccacaggttattagcttgcatcttatgacataaagcagggatccccaaccccaggctgtggactggtatcagtctgtgacctattaagaactgggcctcacagcaggagatgagcaggaggcaaagctttatctgtatttacagctgtcccctaacactcgcattaccacctgagctctgcctcctgtcagatgatcagcccaggcattagattctcacagaagcaggaaccctactgtgaactgcgcatgtgagggatctacgttgcatgctctttaagagaatccagctaatgcctgatgtctaaggtggaacagttccatccccactccccgtgcctggtctgtggaaaaactgtcttctaggaaactggtccctggtgccaaaaaggttggagaccaatgacctaacgggataaagttcaagatttagttataacctgccttttcaaattcatcacccatactcccttccacacaagcaatactccggcaatacacagaattacttacttgtctcccagatagacaacaaacaccactgtctgcaaaccgttgttcacttggttccctttgctatgaagctccactatcccaatacatccatgtttacgtctaacttctgctcgagcctcaaagggtaagtttttttgggttttttttgtttgtttgtttttttgaggcggagtgccactctactgcccaggctggagtgcagtggcacaatctcagctcactgcaacctccacctcccgggttcaagcgattctctttgcctcagcctcccgagcagctgggattacaggcacccactaccatgcccagctactttttttgtatttttagtgagacggggtttcgccatgttggtcagtctggtctcaaactcctgacctcaggtaatccgcccacctcagcctcccacagtgctgggattacgggcgtgagctaccgcgcccggccaagggtaagtttttaaaatatcccttatgaaatttccttccttttctaactcctacaacactgtttgtctacttcccgtgatccttacaagttttcacactatggtatacttttttatgtaaaagactacaagcttctggaagcaaggtatgcatttgattctgttctgtattccccaaacaatacctagaacagagtacatgctcaataatgaatggatgaaactatttatctgcctatttaagtaacaatgtgtatctcaatttgatggggccatgataccgacaaggtcccttagatttggaaaattaaaaggctaacagagtcagaaaaaagtctctctaatattacatctgaatcagaaataacatgaactcacggttctttttaaacatatttcttagttctgtccactgaaagggtctagaagcaatgacaacccatggcaatgattttagtttctaaataccattccttactaaaaagaaccagagccttggagaaatggctgattcctgatcaccttatggaaatataaggtgagtctgggacatcttgttgtgccaaaaaagccaagggaaaacaaacaaacaaacaaaaaaaacagtgatggggtcatgtcaaaatgaaacaggaggagctacctagaaaaagttatcagtagccaaacctgagacaatctgagcattagcaaagactgtaattgattgttaacactgaataaataaaagtccaggagagtatggtgatataaaaaaggaaggaagaaaaatgggggcagcctgtgggagtggcaatttaaaaactacaattctggcacggtggctcacgcctgtaatcgtagcactttgggaggccaaggcaggcagatcacttgaggtcaggagtttgagaccagtctggccaacatagcaaaatcctgtctctaataaaaatacaaaaattagccaggcatggtggcaggtgcctgtaatcccagttactcaggaggctgaggcaggagaattgcttgaatccaggaggcagaggctgcagtgagctgagatcacgccactgcactccagcccgggcaacagagcgagactccacctcaataaataaataaatatatacatacacacatacattcatactacaattttggcccagcatggtggctcacgcctgtaatcccagcactttgggaggccgaggtgggcgaatctcctgaggtcaggagttcaagaccagcctggccaacatggcaaaaccctgtctctactaaaaatatgaaaattagccgggcgtggtggtatgcacctgtagttccagctactcaggaggctgaggcaggagaatcacttgaacccaggaggtggaggttgcagtgaactgaaattgcaccactgcactccagcctgggcaacagagtgagactctgtttaaaataataaaataaaaaatctacaattttgcaacccctattgtaataaccgatttcaggatcaggataatgaaaccaatgagtgaaaggctgtaatgaaacagggtatttacaaggtgccaaaatagtgtcccatagattcctctctaatagcagaagagaaaattttaccttcattatggagagatctggctgcgccaaggaatcaaagttagcattgctcataacgggataacccgtcattaagtgcctcctgatatgactcaatgtgaactgcacttcacctatgatgaagcattctcgtcaaaatgtttaacctggatgcatctcaattaacttccagtttacaggaagtagaggagctagagaaaccagttaaatgacaccacgaggaaataatgaatgcacaaggttacacatcctacaagacaaccagagctggtctcttcaaacaagttaatgcaggcaaaggaaggaaaagggtaaaggaactgttcttaaaaaagagtacaagaaacataaccaaatacaaaggatgtactttgtttggatcctgttttgtcggtttgtttgttttaaagaagtgagagtggtatcaaagacattcttgagacaattaggaaaatttagatttaattgatgcttgatattatattatggaattactttaattttcttagatgtgaaaacagtattgtggttacacatgcataaagtatatgtgattatatataatgtggttgtatacacggagatatggttgtgtgtatgcatgtaatggtttgagacaaagagagagaaactatccttattttaggagatacatgctgaaaacttaggggttaagtattatgatgtttgcaacttactttcaaatttttaacaacaaaaaagggaggtagggaggaaggaaaagacagagtaagagagggaaggagaaaaggagagaaatgggaaggagggaagaaggggaaagaggaagagaagggaggggggtagcagagaaatgactcaaatatgacaaaatgttaacaattgttgaatctaggtcaagagagtatataaatgttatacttttttacctcaactcttagatgtatatgatatttttcataataaaaagttaatggaggaaaaagagaagaacaatttaaaaagcaaacagtttaaaattcatgtaataccatgagactgtcaggaaataagagcactgttactcaagatctgtgagagtataaattgctgcaatgtgactggagggcaatgtggcaatgtctatcagatttataaaagcacctagtcagtatgcccaagatcctgtcctgaagataccttccatatgcacagttcttctttatagcattaactgtaacagcaaaagactagaaatcatctacacatgcatcagtccaaactggttacccaaattatggcatatttgtacaataaatcagcatgtatcttttaaattaaattatctcctcaaaaaatatgacagctctttgggaactgatatgaaagataactgagtcatattttacttaaaaaaaggtgcaaaaataatgtgtacaggatacacgtatgtatagaaaggttacacaagaatgtagttgggtggctagaaggaatgagaaacttttttttttcgctggttactcccttttgcactttttgagtcttgctctattgcctgggctggagtacaatgacacaatcttgactcactgcaaccccccacctcctgggttcaagcgattctcctacctcagcctcccaagtagctgggattacaggcgcatgccaccacgcttggctaattttcgtatttttagtagagacggggtttcatcatgttggtcaggctggtcttgaactcctaacctcaggtgatccacctgcctcagcctcccaaagtgctgggattaaaggagtgagccatggcacccagccccttttgtaccttaattttgtatcacagatatagtaattcattcaaaaaatttgtcgagtattgattgactgtagctataatgaactcttcatgtctccatgctttcactatcaaaacttagttacagtggagtcgcaggaggcctaggaattagggtctgaagtgaatatgtaaggtgaaaatagcatacgacaaaaatatgcctcaaaaatcccttaaggatatgccatacttgagaccaacacagcatctcaataattctaacaccactaatttttactccagcattggaacagttcacagtttcttcaactgactagcagataaaatagctggcttgtatttaggcctcacgttgtgatgttaaaagtgtgtgtctttaaaataccataagcacacatatcacagcaagctaaaacgcactcaggactcaagacagactgaaagaacagattcccatttcccatcttaacgtttgatccacagtcttcactgttcaggttctgtttctcttatttttgtcaccagatgcataaaatttgagtttgcataaatgtacataagatacgttctcaaaaacacatttcaaaaattaagcaaactattacagtagaagagaaagtcacaacccaaatgtttgctgactaggagtaagtaatagcaggctgtaacaaaattctcaggtcaagatgaaaaggagagggtgtggccgggaggttggctcacatctgtaatcccagcactttgggaggccgaggtgggaggatcacttgaggtcaggagttccagaccagtctggccaacatggcaaaaccctatctctactaaaaatacaaaaattagctgggcgtggtggtgcacgcctgtagtcccagctactcgggaggctgaggtgggagaatcacttgaacccaggaggtggaggttgcagtgagctgagatcgcaccactgccttccagcctgggcaacagagtgagactccatcttaaaaagaaaaaaagaaaaaaaaaaaaaaaaggaggccggatgcggtggctcatgcctgtaatcccagcacttttggaggccaaggcaggcagaccacaaggtcagcagtttcagaccagcctggccaacatagtgaaaccccgtctctactaaaaataaaaaaattagccgggtgggttggcatgtgcctgtagtcccagctaccaggaggctgaggtgggagaatcgcttgaacccaggaggcagaggctgcagtgagccgaggccatgccatgacactccagcctaggtgacagagtgagactctgtgaaagaaaaagagagaaagggggagagagagagagagaggaagaacgaaagaaaggaaagaaaggaagaaagaaaagagagagaaagaaagagaaagagaaaaagaaaaagaaggaaaggaaaggaaaggaagagaggagagggtagtaataacacctcttggtcaacatgacatatgatctcaggttctgaccttagctgtagcccattcctttatgttgccattcccatacaccaatacatacattcttcagtctatactctgagtaatcatgtaactgtactaaagtctagtcagctaccactgcacctaaaaactccccaatatttctctctaaccctgccctctctaatgaactccaggccaatattcctactagatacttctcttcttagacaatccatccataggcaactcaaattcaccataacccaaactgaactcactttaatataaagaggccacaaggaagcaaggaaaattcaactgttttctcagagttgaaaatgaacacaaaatggattacagcagtgataaaggaaccttaaggaaaacaaagggcttcccaaacctgtaagtcaagtgtgcattcaagctgaatgtactaatctgtctaaaaacaaatgccttaatcataaaaggatctgggaagcaaaagcaagcagaagaggtgaacgaagaggctttaccacagggaaaaaccaccatccctaaaagtaagctgaatgagggtgtctcagtcccaggccaacagacgtcttacttccctgatggagtcttcctatatgaagagaatattccagtcatttggcttgagtcttcaggtctctctgacttgtttgaaaaaattaaactagcatattaattaggacctagtaagtaaatctgcctatcaaaaaacaatatactctgggtgtggtggctcacacctgtaatcccagcactatggaaggcccaggcgggtggatcacaaggtcaagagatcgagaccatcctggccaacaatggtaaaaccccctctctactaaaaatacaaaaatcagctgggtgtggtgatgcgtgcctgtagtcccaactactcagaaggctgaggcaggagaatcgattgaacctgagaggcggaggttgcagtgagccacgatcgcgccactgcactccagcctggtgacagagcgaagactctgtctcaaaaaaaaagaaaagaaaagaatatactaatcatgccaacacacatatcactgtaaattaataaattaaaatttaggttttacacatcagtcttgtaaagttggttaatgttggtccaaccctgggataaggggatgtctaggcatgctgagcagatcaaatttctgtgagtgttaaaccaaggaccagatctaggatgatggtaaattataaatctccacatgtagctatttaaatgtcaatttaattaaaattaaaaattcagttactttgagccacacttcaaacctctaccatattgaacagtgcagacactgaacatttcaatcattgcagaaagttctatgggacagcactgtactaaaaggtaacctcaaactaacctattccaagttgccttaggaaacagcctgacagcccgagatggctaatgcagaacctgagagctagactgttttctacagaaggtaagaaatatataaaactgtttccttttgcaatgatttcttgaaatcagaatatatagttttagtctttaggatttctgcccctttatcactggatgatactctaatctacaggtaatatagaacagaggtaagaagcacattctctgaagccagactgcctgggttcatatctcacctttgtcccttacaagatgtgtgacctaaagcatgttatttaaccactctaccctttagtttcctcaccagtaggggggaaataatggtacctacctcattaggttactacaggttgaatatccctaatccaaaaatacaaaatccaaagtgctccaaaatccaaaacgttttgagtgccaacgtgatgctcaaaagaaatgctcattgaaacttttcagatttcagattttagattaggaatgctgaatcagtatacagcaaatatttgaaaatctgaaaaaaattcaaaattctcaacacttctgatcccaagcattttagacaagggatactcaacctgtataaggataaaaaaaagtttatatgtataaaatatctagaatcatgctcaataaagaataagtacccagtattaactattacttctactactagtaccattactaccaccaccaccaccaccaccaccagactgtcctgactatccttcagaagacaaagtgaaaaatggctcacacctgtaatcccaacacttcaggaggccgagtcaggcagattacttgaggcccggagtttgagaccagcctggccaacatggcgaaaccccatccctactaaaaatacaaaaattagctgggcatggtggcacgcacctgtaatcccagctacttaggcagctgagataccagaatcacttgaacctgggaggcaaaggttgcagtgagccacaatctcaccagaggagaaatattagcaaatgtgaaagtattaaattaaaacaaggatcacgaagtcagaatgtccgtctacaataaaaagaaaatttttttaagatgaaagggagtaggatgttctccagaaagaatattaaataccgaaaaaagtcatgttttcaagaatgttgcctgacaatgccttacttgtaaggatgacaaaccacaggccaaaagaagtctacataatgaactactgagctatttaaataataaatactgaggaggaactgagaagatataggtttgagttcactggaccaaatgatacttccctgtataaagcacatcttgatatttaaatgcattgtctctcctatactccctaaattacctttacattcacttgatgaactgactgaagatctgatttttcagtaagcaagcatttaatcatattaaatgggctgggcgcggtggcatttaatcacattaaatgggccaggcgtgatggctcacgcctgtaatcccagcactttgggaggctgaggtgggcggatcacaaggtcaggagatcgagaccatcctggctaacacggtgaaaccccatctctactaaaaatacaaaaaaattagctgggcgtggtggtgggcgcctgtagtcccagctacttgggaagctgaggcaggagaatggcatgaaccagggggcggagcttgcaatgagtggagatcgcgccactgcactccagcctgggcgacagagcgagactccgcctcaaaaaaaaaaaatcatattaaattattaaaataccatgccaaacaatgacccaccatgtgttctttgagtggaaacgtgttgtagaaaatcacaccttgctcttgcagacaggcaatttgaaaatctaaaggttaaagtacaaacttcagcaagtgtagtaagacagaaagagtcagagctttgaggacacctaaacccaagcttaaagcttggttctaccatttactagctgtatgacctgagtaactggcagtttatgcttacgagctccatttcactagctgtaaaatgcaggtgaagcattgtgccaattaagtaatatatgtaaagtgcatacaagggtaactggcatgtagcactcgctctcaataagcagttgctacagttagtaaacctccccaagacgacctgccaagagacctcagaataaaatatcaccactttacatgaaaccgcaaaaaatattttgaccaggtattaactattatataaatcatgtgagaatgcctcaaagttaccatttgttttccatattttacaagctattccctaaacaacatatgtctctgtttactgtatttcctattagactatgaataaaaactatttgggcttacaataaaaataactgagttaggcgtggtggctcatgtctgtaatcccaacactctgggaggccaaggcaggcaaatcattcgagcccaggagttcaagaccagtctgggcaacatggtgagaccctgtctctacaaaaaagaaattagctgagcatagtgacatgtgcctgtggtcccagctacctgagaggctaaggcaggaagatcgtgtgaggccaagaggtcaaggctgcagtaagccatgtttgtgccactgcagtccagcctgggcgacctgatgtctcaaagataataataactgcacttcttacagtaaaacaaagtttttaccaggaattcagacacatagaccttcactgatccacactcaaacatggccaaacatgacactacgcacaaacgtctaatatttctccctttccctattaatggacaaaataaataagggaaaatatttttcaaaatttctttcagcgagttgagttccacaaaacaaaacaatacagggtaattgcttacctggaaaatattttgtacttcagatccaccaatccagaatgaatgggggttttccctttcagactagtctgagaaaagacagcagtcaagcatcttccaagattctttccgtttactgtatccagctttcttcaacaaaatcccaaacatgcacttcggtaactgttgaaagacagaaagcaatccatacacccaccatggcaccagcggcaaaggacagcctccaagaaatggaaggaagggtcaatggaatggtggatctgaggcacaggaaaaaagttataacccctgagtcagctatttggcataaaatgcctgcagcagcattcctcacctctgtgttgaaaggatacaaaactcgtaacaaataatggaacatccctaatgttaatatttactcatgataaacagcatgcaacttccaaatgagagcagctaaaaaatacctaccctatcatccatataaattgtcctagaccattcagctacactgaacttccttatccattttctaagacagctcctccaccattagaaaaatagtttgtcagccaaaaagaatgatacgagagggctcaaatatctaccataaagatatttatttacgtacctaacaaaatgttttggtttgctacatataagacatcatatctacatattacccaaatcctctacccttagctaaaatatagtgtgcttcaaaacatataactgaagactgaacttctgactcagtaaaggccagtcccgtacaatggccaatgatcacgtaaactgggaaaaatcataaagaacgctaatatacaatttactaggtgacaccattaaatattaagtcctgtccatattatatcaatattctttttctaccatatcaaattagactgcaaattctaaacaaactaaaagggaaagagaaaaagcattcagcagaacaacaaagataaaaacaaaaagactgaacttactcgaacataaatttgctacttccacaattgctacattatagccaaaatgctcctgcagtaattatagtaatacctaccttattgaaaagctactaactggccaagccctttacattaattacccatatttaattctcaaaaaaagatgagcagaaagaagtaacctatccaaagtcccacatctactaggtagtagagcccatgcccttttcatggagcactatggactccacagttcaagggtcagaaagcccatgatttctgagagaggagaagaaatcaagctttactctcaaaggtcctaaattaattaacatcaaaatggagaacaatgaaaatacagaagagtaaatatttcagcctacatgaatcagttgggccatcctgaaagggtaattccctagatcttgccacttaaaaaagcatttaattaacaaagagccatgcaattctacagcccatgatatttttttcttgtctttttttttttttttttaagtagagacagggtttcaccatgttgcccaggctggcctcgaactcctaagctcaagcgatctgcctaccttggcctcccaaagggctgggattacaggtgtgagcccccatgcccagcctaaagcccacaatattaatgctaaaacaaaacacattataggctgggctcgatggctcacacctgtagtcccaacattttgggaggccgaggcgggcagatcacttgaggtcaggagtgtgaggccagcctgaccaacatggtgaaaccccatctctactaaaagtacaaaaattaaccgggcctggtggcacatgcctacaatcccagctactcgggaggctgaggaaggagaatcacttgaacccgggagacagaggctgcagtgagctgagatcgtgccactgtactccagcctggttaacagagcaagactccgtctcaaaaaaaaaaaaaaaaaaaagactgtggcaagacatactataatggtactcaagtagtctttgtgtttagcagcaaagattgtaactgtgacaaagaatctcaaatccagctgaacccaagtaatttttaaattctaagatttgttgacagtccacaggcaatgactcttaaagatgttctgattgttcatattgtaggtaaggcaattaaagtgactgaaataccggtctatgattaacctcgccataacaatcagatgaaaataccttaagactcacaactttaaggagatcacaaaagtaaaatcccaagcaaataatgagttctcaagtttttcccattaagtggtattactcctaagcctaagaataaactggaaacccaattttgacagaagtagctagggaactatggctagtagcgaactgctaaaacagtatactatgcttttcaaggtacgactatccaaaatgcaaaacaagttatagcaaaacacaaccacagcaatttgactaacagactcatttctggacctcttgaatcctcaggcttttcccctgtactagtgagttaatttttctcccttcccttcaaaaaaaaaaaatatatatatatatacacacacatatatatttcttcaatccctaattgtatatatatatttcttcaatccctaattgctggcaggccttatgctagtaatacaaagattaacagatgccaggtgagtagtgtcaggactgagttcttcctgcccctctgccccctttctctttgaatctatcatgtagtcatttcagagggccaaaatatattttattgttagttaccaaaactggttcaatgttctccagttaactcctaaaaaaataaacattaaaaattactcaagttcctttttcacaatagtagaacctcagtctttctttttcttctgtggatcagaggctttttactatacaatggtttcctacattcaatatgcttatatttacacacctctctatcacaagccaaagagccaaagcttttttttttatttttcctattaatgtcccagtgtttatacttcacagctttccattttgtgaagctcttcattgttaactcaacctgagagggaatttcctaaaaacgcttcccgctgacatcacagaactcttccatcttttagtttcattaaaacactaagaaccaggtaagagataccctactggattgtcaggtcttcctggtctgtctctcatttgcctacaaagacaaacttcctcttaagcaattgcgatcagcagaaactaaccaagggtaacgagcacattcttaaccaacacgtttcttcccccattgtcatctaattcaatgaacaatacaactcagaagaaaatcttgtatgaattctcactgcttattctgttaaggttaaaaccatcagctttgatgatggtaagaataagaattcaaaaaccacaatttggtcagtctaaactaaaccgatcaaacataaatcccaatgctcaatgtcaatataaactaatcaccagtctctttctgtcaggataccaggcataaaaataggactgggtgggttctctctgtagttacagcatagatctaattacgccaaattggtagtcattgaaatagtacctcccagattttccaagacagtattgactctgcatgatttcattgtttttcccaaagatggctcattaaatgtatggctaaaagcaactaaatgttagtcttctgtaaagcctcacaaataaatacatgcgcaactcaggagaaagaccttttccacaccatcggtcttgacttcgctttagggtccctgtacttgtggggaaagttagtatggtcagcatttgaagaaaagcaagcctctgcaaagtcctttcacacacatctctcatataatcctcccaacaactcagaccaatacctaagttttcttatttatttttacatataatcaaatcatactgcagaaaggttacctttctttatgtcacacagctagcaagcgacagagcttggatacaaactcaggtgtttcacttcaaagcccatgccctttctgctaaaccatgcttttctaaggtcatggagcccttggagcttatcaactatttggcaaacctgcaccaactgatgcaaaaagtattcagtttcctcagttctttgctaacaaccagtctctgagttctatgtaaatcaatctgtatgtgtggaaagtctgtaaataatggttaatatgtctatggatgtcctataaacaacacaccacccacctcttccccctccccatctttcttctctattcatctctacctttgtcttaagatattcaaaaggaaatcttaaaaggtttcactgcatgaaagaaagaaaatctaacattaatttaaatccatattgagcacccatgtgctgaggagtaacagggcaatcaaacacagcctctagaagaagagtttaggcacaaccacaagtttttataatataataggatgatatgataagtcccataaaaatttggaactgattattgtgagaattagtaatgtgggtgaaaatgtttagaaaagaggatagttaagacacaggcaaaaggcaataatgtctgaaaatgatcaccaggaaaattcaacccaacatttcctgaaagcctaccacaaagaagacaccgtgtgtatgaaggaactgtgtgtcactggaagataattaaggtcccagcccttcccatgaggagtttatcattcaacagaggacacaaacaggtaactatattacaagcctgaaatatgttaagtgctacaggataaatacaaagtgccagaattcattcatttcatttgagtgtcatataggcagtgctatacagacacaaaaaccagacagtctctgctaccataatataaactgacatcaaaagaggtggcacctattgtgttttatgggtggataggacttcattagcataaatgaaagagaagattgctgagatataacctaagccaatttggccagagaaccacctattagatccttttgataaatatcagtagccttcaataaatgggcttaggtccattcctatcagtgctgacaaaggaaacgtgtgagcagaatctggaggaccatggtcctccatgtgctagaatatacagtaagcaaggaaagtaggcagaaaagccataagggagaatggaatacaaaggaagactggaattggaatcactaggacttaaaatgctttgttttctatgaagaacaaatatcacaaggtagaacccaggatcccacagatcttacagggcagataattttgtttctagaattcacaggctcaaacaacactagtaagaggcatatatgtgctgttgtgaatctatgtaatggctgagtgattctcctgggctagctccctatttgcaggagacagactatagcagtcaagagcccagaatgccaagacttgtgtgcaggaacatgtttatccatgtcaaatctgaaaggatatctaacctactgcaaaatcaggggcaaaaattgatatatttgagccaatgcctctttaggcaggtcagtgaggtccatatattttatataaatgtgtgtgtgtgtgtgtgtgtgtgtgtgtgtggtttattcatttggaccctattgaaacctgtgtccactgagtctgcattcagtaagttagcacccctagtggtgtgctacatgaggagaaaggtggtgacaaagtaatatccaatttcttgatgaagtcactaaacaaccccactcaccccgagaaagtcaatgacaggaagaaaaaaaaaagatccaaaaagaaaaaaagacaacatttccagtaacttcatttattcgtttctttcttttttcttttctttttttttttttttttttttgagagtgtcttgctctgttacccaggctggagtgcagtggcacaatcacaggtcactgcaacctcaaactcctgggctcaagcaatcctccccacctcaggctcctgagtagcagggactataggagtgaaccactatgcctggctaatttttttattttttgtagagacagggttttgttatgttgcctaggctggtctctaactcctgggctcaagcaatcctcccacctcctaaagtgctgggattacaggctagagccaccgcacctgcccacaccttcttaataaggatcagtgtattttaacctacattacttcattgaacaagtaatacagccacttaagagataagacagaagggaaatgactcacttaaggtcacttagcaaaaagggaagtcatttaacaattaattataaaccatccattaattgtgtaaagggaagaggggattcactcacacccgtggaggaggcaggatcgcctttcctaaagtgatagcatcaatttctgctggcttcttacagggtaatctaatcatctttctcttccaatcagaagctcttgtgagtgctttctagtgatgagtgcctgaaaatcaagtcatattcctaactcaaaggttaataaataccacgtgatacatattgtacagttctcattcttcccaatgaagtccattgaacatagccggataaactttacatatttccaaaatgaattactagttttctgcctcattcataaggcgaattttaccaaactcagaagtttggaaaaataggcccactaacaggtatagccctgggccaatataaggccctaaaagtcatctggcggttaaattatttaccattagtaactgtaaattcagggtctaaattaagagcttatagactttactaatattcaaagctgaatcctatagagtgggtcaggaggagaagcaacctgggtggacccaggcctcaggcagcggtaggagtcaaagtgggggttatattttagaaatttaactattctgctatcaccagctttatttcctaatatacttatcaaaaatgcaaggaaaaacagaagaatcaatattaaggaaagtacagggatgaagattagaaaatggagataaccaagaagtctgtttcctctttttaatacagcacactttggaacagcaaatgaaagttatcttgttaagcattaagtgccaaactggtacaagcagcacaatcacaaatatttgagtactgaagctgactcataaaaatctaaaaatatttcatgctttaggctttcaaaacaccatcagtttaaccccttttcctccatcaatcgtattatcttgaaaccaatgtaaaaaatatttttaacccagttctggaaactgtaattgaaatgcagtgaaaacagaaagccacatgcaattagattctaaggcattatttcctacatttgatcctggatttactcaatcagttgttaagcacctgtgctactttactaaaataaatacacatatttaatttatgataagggttgtctaagagtcttaactgatatccctttcaggaaatatcaaaatccttaaataaaaggccattttaaaattaatcgtaatataactaaactctgttaaattttcaaagaattccagtttaaatcccagtttataatgtccttaacaggctgaaatctcttttctgatcaaaaccaagtgctatcatgtaaaatcaaaactttttaagttataagcataggaagccagtgaatttaggccaaaggtttttatttttttattttgtaaccatacactgacttgggttacaacgtatttcttataattcttttgaaaataaatacattttcgttattttttaaaggaatagaaatggaaggagctgggaacagccaatttcaaagaggcaccaagttacaatttttcgatatgaagtacttctgttgtaagtacatgcactgtgtgtacattcttaagaatatgtaatatacttagtcgatttaagatagttaccaaaataacccactacaaaagttacagaataccaaacacttgactacaagtatgataaattatgctgaaaaggaaaaatcactcagtatgtgacatccctttgaaaacaaccccacgtgcacacacacacacacacacacacacgcatgcaaaaatcaaaaactatcagtttctttttttccctcctagttttcaagaatgctagagaagtccagttctgtgaattatgcaaaggacagcaaacattaagctgcctccatatttatgctactgtacttccatttttaaaacaagcatctcaactccccagacaccatcatccacagaaaccatgcagctatccaacagactttcagtgtcaccatttattatttatagcgttaaatgggggaagtggctctgatgtcaccaaccctacccagtggaatcactgactcaataaacattttcacactgaagaaaatctggctaggaaaacattttgctgggttaagtagattcttccacctctcctctcaaccctggggaagaagttgttaccgtgttaggaaagatacaaagaaactgtcaaggcttccataggaagaaatcctggacatgtccatttgctgatgcagacttcctcttcccagctctccagagcccaatttgatttccctcatgttcacgttggcaggtaatatctgccatattttatttcttccaccaaatcatccatcaattagcaaattcttcacttctagccactctctcactgtcctgttcctaaaaaccccttctggtttcaaatcctaaagcttcggaggagggtggagggtgtccacggaccgggagtctggcctggctgccagtggtttctaacagaagagtggtcgcttcccccgggggccaaggattcccctcttttttttttctttctgagaagaaagacctcgcggcagtgatgaggatggctccctccccagtcatctccaatttcccaaagcagctctggaaaacgtgaagttgcgccttctctttcctggaggatggaatccagagtacctgggcccttgctatgcaaacatccctctccgccgggtaggaaaccctttgtccgagaagccggacaccacaagggcccgggaaagaggcctccttatccgccacagcctcaaacccgaaagctccctgcccccccagctctgtagggcctatcctggcatccacacagacctaggctggggagtgggtgctgagacctctcctaggacgcggaggcccaggcggccccaacccatctccgtactccttcccaccatctcactcggcctgagtggggcttgcaagcgcggtgcgggcctgggccgaaacagaggaaagaaaaaaaaatccctttctaaaagaaggagaatggggtgctagagcgagtgcgacctaagtctacagcataaacgagcgagggtcgtccgagagctgggaccggagacgggaccagggggagggggagaagcgaggggcatggagggggccgggccaggaccggccggagatgtcgagggatcagaggagcccgcgccaggtccgaggccagggaaggctgggggcccgggtctgggtcgaggcgtctgggaagggccagagccggcctcgcaccggacgttgaggtgggcaggcccgcccggggccggacggacggaagcacagacggtccagcgggccgcactcaccatgagctcgatggtcttgtcctcaatcaccgagtcgggctccatggcggccccggcggccccgcctcgctctccccgcgcagcagcgaacggcccgggcggaggaggcgacggcggaggcggcagaggcggaggcggctatcgcacccactctagctgccagcccgcccgggccgccggcagctccgccctccccctcggcgaacgcagtacgcagatcggggactacacctcccagcaggcgccgcggcccgcagagcgttgtgggaccgagcctctgacaccaggttgctggctcttggcagcccgaagctgaactccgagctgagagtagcactggacggtgggcgtaggacgtgcagacctgaagagttaagagcttgctcatggcagggcctcgagagcgccacgactac

SEQ ID NO: 435 - DNA, 145323 bp, Homo sapiens; identical to SEQ ID NO: 434

SEQ ID NO: 436 - DNA, 145323 bp, Homo sapiens; identical to SEQ ID NO: 434
